United States Patent
Lewin et al.

(10) Patent No.: US 10,626,462 B2
(45) Date of Patent: Apr. 21, 2020

(54) METHODS AND NUCLEIC ACIDS FOR DETERMINING THE PROGNOSIS OF A CANCER SUBJECT

(75) Inventors: Joern Lewin, Berlin (DE); Manuel Krispin, Berlin (DE)

(73) Assignee: EPIGENOMICS AG, Berlin (DE)

( * ) Notice: Subject to any disclaimer, the term of this patent is extended or adjusted under 35 U.S.C. 154(b) by 191 days.

(21) Appl. No.: 14/131,445

(22) PCT Filed: Jul. 9, 2012

(86) PCT No.: PCT/EP2012/063436
§ 371 (c)(1),
(2), (4) Date: Oct. 17, 2014

(87) PCT Pub. No.: WO2013/007702
PCT Pub. Date: Jan. 17, 2013

(65) Prior Publication Data
US 2015/0031021 A1    Jan. 29, 2015

Related U.S. Application Data

(60) Provisional application No. 61/505,919, filed on Jul. 8, 2011.

(51) Int. Cl.
*C12Q 1/68* (2018.01)
*C12Q 1/6886* (2018.01)

(52) U.S. Cl.
CPC ..... *C12Q 1/6886* (2013.01); *C12Q 2600/106* (2013.01); *C12Q 2600/118* (2013.01); *C12Q 2600/154* (2013.01)

(58) Field of Classification Search
None
See application file for complete search history.

(56) References Cited

U.S. PATENT DOCUMENTS

| | | | | |
|---|---|---|---|---|
| 2003/0068620 | A1* | 4/2003 | Markowitz | C12Q 1/6827 435/6.14 |
| 2010/0143929 | A1 | 6/2010 | Levenson et al. | |
| 2011/0027789 | A1 | 2/2011 | Lewin | |

FOREIGN PATENT DOCUMENTS

| | | |
|---|---|---|
| CN | 101076605 A | 11/2007 |
| EP | 2 341 150 A1 | 7/2011 |
| JP | 2008245635 A | 10/2008 |
| WO | 2005040421 A2 | 5/2005 |
| WO | 2007118704 A2 | 10/2007 |
| WO | 2008009479 A1 | 1/2008 |
| WO | 2008/107134 A2 | 9/2008 |
| WO | 2010032797 A1 | 3/2010 |

OTHER PUBLICATIONS

Ehrlich et al. (2002 Oncogene vol. 21 p. 5400).*
Walsh et al (Genes & Development (1999) vol. 13, pp. 26-36).*
Cheung et al (Nature Genetics, 2003, vol. 33, pp. 422-425).*
Cobb et al (Crit Care Med 2002 vol. 30 p. 2711).*
Enard et al. (Science 2002 vol. 296 p. 340).*
Benner et al. (Trends in Genetics 2001 vol. 17, pp. 414-418).*
DeVos et al (Clincial Chemistry 2009 vol. 55 p. 13374).*
Kim et al. (Journal of clinical oncology 2004 vol. 22 p. 3443).*
Hoffman et al. (J Cancer Res Clin Oncol 2009 vol. 135 p. 1231).*
Diffenbach (PCR methods and Applications (1993) vol. 3, pp. S30-S37) (Year: 1993).*
Roux et al(PCR Methods and Applications (1995) vol. 4, pp. s185-s194). (Year: 1995).*
Kollermann et al., "Impact of hormonal therapy on the detection of promoter hypermethylation of the detoxifying glutathione-S-transferase P1 gene (GSTP1) in prostate cancer," BMC Urology, 6:15 (pp. 1-6) (2006).
English translation of Office Action dated Jan. 21, 2015 in corresponding Chinese Patent Application No. 201280033813.X.
Ashour et al. (Mar. 2011) "A DNA hypermethylation profile for prostate cancer diagnosis and prognosis," Article No. 512. European Urology Supplements. 10(2):172.
Kijima et al. (May 2011) "[Examination of methylation of RASSF2A gene and malignancy in large intestine tumor tissues]," Article No. PS-058-7. Journal of the Japan Surgical Society. 112:606.— provided with English machine translation.
International Search Report with Written Opinion corresponding to International Patent Application No. PCT/PCT/EP2012/063436 (WO/2013/007702), dated Sep. 27, 2012.
Devos (2009) "Circulating methylated SEPT9 DNA in plasma is a biomarker for colorectal cancer," Clin. Chem. 55(7):1337-46.
Kijima et al. (May 2011) "[Methylation and malignancy of RASSF2A gene in colon cancer tumor tissue],"[Japan Surgical Society Magazine]. 112(1.2):606.
Japanese Office Action corresponding to Japanese Patent Application No. JP2014-517844, dated May 23, 2017 [Translation Only].
American Cancer Society "Colorectal Cancer Stages," 2017 American Cancer Society, Inc. Accessible on the Internet at URL: https://www.cancer.org/cancer/colon-rectal-cancer/detection-diagnosis-staging/staged.html [last accessed Aug. 7, 2017].
Hermanek et al. (Jan.-Feb. 1994) "Residual tumor (R) classification and prognosis," Seminars in Surgical Oncology. 10(1):12-20.

* cited by examiner

*Primary Examiner* — Katherine D Salmon
(74) *Attorney, Agent, or Firm* — Lathrop GPM LLP; James H. Velema, Esq.; Sean M. Coughlin, Esq.

(57) ABSTRACT

The invention provides methods, nucleic acids and kits for determining the prognosis of a subject having cancer. The invention discloses genomic sequences the methylation patterns of which have utility for the improved detection of said disorder, thereby enabling the improved diagnosis and treatment of patients.

19 Claims, 15 Drawing Sheets
Specification includes a Sequence Listing.

METHODS AND NUCLEIC ACIDS FOR DETERMINING THE PROGNOSIS OF A CANCER SUBJECT

FIELD OF THE INVENTION

The present invention relates to genomic DNA markers useful in determining the prognosis of a cancer subject, determining medical treatment for a cancer subject, determining if a tumor from a cancer subject indicates that the tumor is aggressive or has metastatic potential or indicates a reduced survival time for the subject, detecting an aggressive form of cancer in a subject, selecting a cancer subject for cancer treatment, or determining tumor load or cancer burden in a subject. Particular embodiments provide methods, nucleic acids, nucleic acid arrays and kits useful for determining the prognosis of a subject having cancer.

BACKGROUND

Methods for determining the prognosis, and thus methods and agents for determining treatment, of a cancer patient include determining the staging of the tumor based on various criteria. Often this determination includes invasive procedures to observe histological changes in tissue morphology and the level of invasion of the tumor into neighboring tissue and metastasis.

In particular, colorectal cancer is the second most frequent cancer in Europe and in the the US (412,900 and 150,000 individuals in 2006, respectively). In 75% of cases disease is removed by surgery. However, there is recurrence in 30-40% of stage II-III colorectal cancers, most within 3-5 years of initial diagnosis. Moreover, only 16-66% of patients are symptomatic at diagnosis of recurrence and of these tumors only 1.7-7% are respectable. Thus, 93-98.3% of recurrent cases are identified past the time where resection is sufficient to remove all of the tumor or tumor cells. See Fakih, M. G. MD, CEA Monitoring in Colorectal Cancer, *What You Should Know*, Volume 20: Number 6: 2006.

Current practice guidelines for post-resection surveillance for Stage II and greater tumors include monitoring CEA (Carcinoembryonic antigen) every 3-6 months for 2 years then every 6 months for a total of 5 years, and/or colonoscopy after 1 year, optionally repeated every second year. For colorectal Stage I and II patients who are positive for CEA before surgery, only 3% to 32% of patients can be monitored by CEA-based monitoring, leaving 68-97% of Stage I & II patients who cannot be monitored at all with CEA. Furthermore, CEA sensitivity depends on the site of recurrence such that only a portion of the 3-32% of patients who can be monitored can benefit.

Currently, the only valid prognostic marker in predicting the outcome of colorectal cancer (CRC) patients is the Tumor-Node-Metastais (TNM) staging system. The parameters of this system are generally qualitative and are not informative for further differentiating risk in standard risk patients, who constitute the majority of stage II colon cancer. Approximately 30% of patients with colon cancer have a stage II disease. Current National Comprehensive Cancer Network (NCCN) guidelines do not recommend the routine use of adjuvant chemotherapy for all patients with stage II colon cancer but rather consider adjuvant treatment in the setting of high recurrence risk. The five-year survival rate for the overall stage II patient population has been estimated to be 75-80%. Despite these relatively high cure rates with surgery alone, in a significant proportion of stage II patients cancer will recur. The identification of markers that distinguish those patients at low risk from those at higher risk of disease recurrence, would be helpful to identify those patients who would be candidates for adjuvant chemotherapy. Biomarkers in stage II colon cancer to date have been limited to clinical diagnosis, but not use in prognosis or clinical outcome.

Several proteins and genetic markers have been described in an attempt to improve prognostic information and to predict the benefit from systemic treatment. Unlike other types of cancer, with the exception of KRAS mutation, none of the studied markers has entered into the clinical management of colorectal cancer so far.

CpG island methylation: Aberrant methylation of CpG islands has been shown to lead to the transcriptional silencing of certain genes that have been previously linked to the pathogenesis of various cell proliferative disorders, including cancer. CpG islands are sequences that are rich in CpG dinucleotides and can usually be found in the 5' region of approximately 50% of all human genes. Methylation of the cytosines in these islands leads to the loss of gene expression and has been reported in the inactivation of the X chromosome and genomic imprinting.

DNA methylation and disease prognosis: DNA methylation has been shown to be associated with patient prognosis in a number of publications such as EP 1692316 and WO 2007/085497.

There is a need for a better means to determine a patient's prognosis, clinical outcome, tumor load, cancer burden, and/or inclusion in a treatment group, at any point starting at initial diagnosis and continuing during the course of treatment, including the ability to determine the status of relapse, remission, or recurrence, using minimally invasion testing techniques.

SUMMARY OF THE INVENTION

The invention provides a method for determining the prognosis of a cancer subject, comprising the steps of: measuring the pre-treatment level of methylated genomic DNA of a gene, or a fragment thereof, in a biological sample obtained from the subject; measuring the post-treatment level of methylated genomic DNA of the gene or a fragment thereof, in a biological sample obtained from the subject, whereby an increased or equivalent amount of the methylated genomic DNA or fragment in the post-treatment sample compared to the pre-treatment sample indicates additional cancer treatment for the subject. Within an embodiment, an increased amount of the methylated genomic DNA or fragment in the post-treatment sample compared to the pre-treatment sample indicates that the cancer is aggressive or has metastatic potential or reduced survival time for the subject. In a preferred embodiment the method of the invention provides a method for determining the prognosis of a cancer subject, comprising the steps of: a) measuring the pre-treatment level of methylated genomic DNA of a gene, or a fragment thereof, in a biological sample obtained from the subject; b) measuring the post-treatment level of methylated genomic DNA of the gene or a fragment thereof, in a biological sample obtained from the subject; and c) comparing the measured post-treatment level and the measured pre-treatment level of methylated DNA, whereby an increased or equivalent amount of the methylated genomic DNA or fragment in the post-treatment sample as compared to the pre-treatment sample indicates a bad prognosis and, thus, a need for additional cancer treatment for the subject. In a preferred embodiment of the method, the method comprises steps c) and d) as follows: c) comparing the measured post-treatment level and the measured pre-treatment level of methylated DNA and d) determining the prognosis of a cancer subject based on the result of the comparison of step c), whereby an increased or equivalent amount of the methylated genomic DNA or fragment in the post-treatment sample as compared to the pre-treatment sample indicates a bad prognosis and, thus, a need for additional cancer treatment for the subject.

Stable or even increased levels of the methylated genomic DNA, preferably, indicate that the chosen treatment failed to remove the cancer cells discharging the methylated DNA fragment or that their number increased despite of treatment, i.e. the cancer grew further. In contrast to this, decreased levels of the methylated genomic DNA, preferably, indicate that the number of cancer cells decreased, i.e. that the treatment was successful in reducing tumor load of the patient. In particular, a decrease to levels which are below the level of detection, indicates that all cancer cells may have been eradicated from the patient, i.e. a cure of the cancer. Typically, a cancer which responds poorly to treatment is considered aggressive.

If the applied cancer treatment is localized treatment, a decrease of the level of the methylated genomic DNA to a level below the limit of detection, preferably indicates a cure of the cancer. It will be understood by the person skilled in the art that—depending on the outcome of clinical studies—other threshold levels for defining a "cure" of a patient may be defined. The establishment of such threshold levels can be achieved by statistical methods conventional in the field of (medical) statistics.

However, if the level of the methylated genomic DNA measured after localized treatment is above the level of detection, this, preferably, indicates that localized treatment was insufficient to achieve a complete cure. This is typically the case if the cancer already spread beyond the area affected by the localized treatment. Therefore, even in the case of a decrease of the level of the methylated genomic DNA, the continued presence of detectable levels of the methylated genomic DNA indicates a poor prognosis because a cancer which spreads beyond its site of origin is, typically, much more difficult to treat.

The selection of further treatment of a cancer patient depends on his/her prognosis. If the prognosis is good, subsequent treatment does not need to be as aggressive as in cases with a bad prognosis. As the prognosis of the patient is an important parameter for the selection of further treatment of a cancer patient, the invention provides a method for determining medical treatment for a cancer subject, comprising the steps of: measuring the pre-treatment level of methylated genomic DNA of a gene, or a fragment thereof, in a biological sample obtained from the subject; measuring the post-treatment level of methylated genomic DNA of the gene or a fragment thereof, in a biological sample obtained from the subject, whereby an increased or equivalent amount of the methylated genomic DNA or fragment in the post-treatment sample compared to the pre-treatment sample indicates additional cancer treatment for the subject. In a preferred embodiment the invention also provides a method for determining which kind of medical treatment is suitable for a cancer subject, comprising the steps of: a) measuring the pre-treatment level of methylated genomic DNA of a gene, or a fragment thereof, in a biological sample obtained from the subject; b) measuring the post-treatment level of methylated genomic DNA of the gene or a fragment thereof, in a biological sample obtained from the subject; and c) comparing the measured post-treatment level and the measured pre-treatment level of methylated DNA, whereby an increased or equivalent amount of the methylated genomic DNA or fragment in the post-treatment sample compared to the pre-treatment sample indicates additional cancer treatment for the subject. In a preferred embodiment of the method, the method comprises steps c) and d) as follows: c) comparing the measured post-treatment level and the measured pre-treatment level of methylated DNA and d) determining based on the result of the comparison of step c) which kind of medical treatment is suitable for a cancer subject, whereby an increased or equivalent amount of the methylated genomic DNA or fragment in the post-treatment sample compared to the pre-treatment sample indicates additional cancer treatment for the subject.

Preferably, a post-treatment level of the methylated genomic DNA which decreased below the level of detection indicates that no further medical treatment is required. In these cases, a monitoring of the patient for relapses may be sufficient. However, if the post-treatment level of the methylated genomic DNA does not decrease or even increases, additional medical treatment may be necessary. As an increasing level of the methylated genomic DNA indicates a failure of the the treatment, this situation, preferably, indicates the need to switch to a different kind of treatment.

It will be understood by the person skilled in the art that the choice of a suitable treatment of a cancer patient cannot be not exclusively based on the result of a single laboratory test. This decision is, preferably, based on medical judgement of the patient's condition. Said judgement, preferably includes results of conventional diagnostic methods such as imaging methods as well as the general stat of health of the particular patient in addition to the results gained by applying the method of the present invention.

The invention provides a method for determining if a tumor from a cancer subject indicates that the tumor is aggressive or has metastatic potential or indicates a reduced survival time for the subject comprising: measuring the pre-treatment level of methylated genomic DNA of a gene, or a fragment thereof, in a biological sample obtained from the subject; and measuring the post-treatment level of methylated genomic DNA of the gene or a fragment thereof, in a biological sample obtained from the subject, whereby an increased or equivalent amount of the methylated genomic DNA or fragment in the post-treatment sample compared to the pre-treatment sample indicates that the cancer is aggressive or has metastatic potential or indicates a reduced survival time for the subject. In a preferred embodiment the invention provides a method for determining if a tumor from a cancer subject indicates that the tumor is aggressive or has metastatic potential or indicates a reduced survival time for the subject comprising: a) measuring the pre-treatment level of methylated genomic DNA of a gene, or a fragment thereof, in a biological sample obtained from the subject; b) measuring the post-treatment level of methylated genomic DNA of the gene or a fragment thereof, in a biological sample obtained from the subject; and c) comparing the measured post-treatment level and the measured pre-treatment level of methylated DNA, whereby an increased or equivalent amount of the methylated genomic DNA or fragment in the post-treatment sample compared to the pre-treatment sample indicates that the tumor is aggressive or has metastatic potential or indicates a reduced survival time for the subject. In a preferred embodiment of the method, the method comprises steps c) and d) as follows: c) comparing the measured post-treatment level and the measured pre-treatment level of methylated DNA and d) determining based on the result of the comparison of step c) if a tumor from a cancer subject indicates that the tumor is aggressive or has metastatic potential or indicates a reduced survival time for the subject, whereby an increased or equivalent amount of the methylated genomic DNA or fragment in the post-treatment sample compared to the pre-treatment sample indicates that the tumor is aggressive or has metastatic potential or indicates a reduced survival time for the subject.

Moreover, the invention provides a method for determining if a tumor from a cancer subject is aggressive and/or has metastatic potential comprising the steps of a) measuring the pre-treatment level of methylated genomic DNA of a gene, or a fragment thereof, in a biological sample obtained from the subject; b) measuring the post-treatment level of methylated genomic DNA of the gene or a fragment thereof, in a biological sample obtained from the subject; c) comparing the measured post-treatment level and the measured pre-treatment level of methylated DNA, whereby an increased or equivalent amount of the methylated genomic DNA or fragment in the post-treatment sample compared to the pre-treatment sample indicates that the tumor is aggressive and/or has metastatic potential. In a preferred embodiment of the method, the method comprises steps c) and d) as follows: c) comparing the measured post-treatment level and the measured pre-treatment level of methylated DNA and d) determining based on the result of the comparison of step c) if a tumor from a cancer subject is aggressive and/or has metastatic potential, whereby an increased or equivalent amount of the methylated genomic DNA or fragment in the post-treatment sample compared to the pre-treatment sample indicates that the tumor is aggressive and/or has metastatic potential.

The invention provides a method for detecting an aggressive form of cancer in a subject, comprising a) measuring the pre-treatment level of methylated genomic DNA of a gene, or a fragment thereof, in a biological sample obtained from the subject; b) measuring the post-treatment level of methylated genomic DNA of the gene or a fragment thereof, in a biological sample obtained from the subject, whereby an increased amount of the methylated genomic DNA or fragment in the post-treatment sample compared to the pre-treatment sample indicates that the cancer is an aggressive form. In a preferred embodiment the invention provides a method for detecting an aggressive form of cancer in a subject, comprising a) measuring the pre-treatment level of methylated genomic DNA of a gene, or a fragment thereof, in a biological sample obtained from the subject; b) measuring the post-treatment level of methylated genomic DNA of the gene or a fragment thereof, in a biological sample obtained from the subject; and c) comparing the measured post-treatment level and the measured pre-treatment level of methylated DNA, whereby an increased amount of the methylated genomic DNA or fragment in the post-treatment sample compared to the pre-treatment sample indicates that the cancer is an aggressive form. In a preferred embodiment of the method, the method comprises steps c) and d) as follows: c) comparing the measured post-treatment level and the measured pre-treatment level of methylated DNA and d) detecting based on the result of the comparison of step c) an aggressive form of cancer in a subject, whereby an increased amount of the methylated genomic DNA or fragment in the post-treatment sample compared to the pre-treatment sample indicates that the cancer is an aggressive form.

The invention provides a method for selecting a cancer subject for cancer treatment comprising: measuring the pre-treatment level of methylated genomic DNA of a gene, or a fragment thereof, in a biological sample obtained from the subject; and measuring the post-treatment level of methylated genomic DNA of the gene or a fragment thereof, in a biological sample obtained from the subject, whereby an increase in the amount of methylated genomic DNA of the gene in the post-treatment sample compared to the pre-treatment sample indicates additional cancer treatment. In a preferred embodiment the invention provides a method for selecting a cancer subject for additional cancer treatment comprising: measuring the pre-treatment level of methylated genomic DNA of a gene, or a fragment thereof, in a biological sample obtained from the subject; and measuring the post-treatment level of methylated genomic DNA of the gene or a fragment thereof, in a biological sample obtained from the subject; comparing the measured post-treatment level and the measured pre-treatment level of methylated DNA, whereby an increase in the amount of methylated genomic DNA of the gene or the fragment thereof or an equivalent amount of said DNA or the fragment thereof in the post-treatment sample compared to the pre-treatment sample indicates the need for additional cancer treatment. In a preferred embodiment of the method, the method comprises steps c) and d) as follows: c) comparing the measured post-treatment level and the measured pre-treatment level of methylated DNA and d) selecting based on the result of the comparison of step c) a cancer subject for additional cancer treatment, whereby an increase in the amount of methylated genomic DNA of the gene or the fragment thereof or an equivalent amount of said DNA or the fragment thereof in the post-treatment sample compared to the pre-treatment sample indicates the need for additional cancer treatment.

Consequently, the present invention provides a method for determining the success of a treatment against cancer in a subject comprising the steps of a) measuring the pre-treatment level of methylated genomic DNA of a gene, or a fragment thereof, in a biological sample obtained from the subject; and b) measuring the post-treatment level of methylated genomic DNA of the gene or a fragment thereof, in a biological sample obtained from the subject; c) comparing the measured post-treatment level and the measured pre-treatment level of methylated DNA, whereby (i) an decrease in the amount of methylated genomic DNA of the gene or the fragment thereof in the post-treatment sample compared to the pre-treatment sample indicates that the treatment was successful and (ii) an increase in the amount of methylated genomic DNA of the gene or the fragment thereof or an equivalent amount of said DNA or the fragment thereof in the post-treatment sample compared to the pre-treatment sample indicates that the treatment was not successful. In a preferred embodiment of the method, the method comprises steps c) and d) as follows: c) comparing the measured post-treatment level and the measured pre-treatment level of methylated DNA and d) determining based on the result of the comparison of step c) the success of a treatment against cancer in a subject, whereby (i) an decrease in the amount of methylated genomic DNA of the gene or the fragment thereof in the post-treatment sample compared to the pre-treatment sample indicates that the treatment was successful and (ii) an increase in the amount of methylated genomic DNA of the gene or the fragment thereof or an equivalent amount of said DNA or the fragment thereof in the post-treatment sample compared to the pre-treatment sample indicates that the treatment was not successful.

Preferably, a treatment which was "successful" achieved at least one of the following effects: remission of the cancer, increase of the time to recurrence of the cancer, increase of the time to tumor progression, alleviation of the symptoms of the cancer, reduction of tumor mass and decrease of the number tumors. More preferably, a "successful treatment", characterized by a cure of the cancer, i.e. the complete eradication detectable and non-detectable tumor cells. A preferred indicator of the cure of the cancer is a recurrence free survival of the patient for at least 5 years or, more preferably, at least 10 years.

A treatment which was "not successful", preferably, failed to achieve any of the aims described above.

The invention provides a method for determining tumor load or cancer burden in a subject comprising: measuring the pre-treatment level of methylated genomic DNA of a gene, or a fragment thereof, in a biological sample obtained from the subject; and measuring the post-treatment level of methylated genomic DNA of the gene or a fragment thereof, in a biological sample obtained from the subject; whereby an increase in the amount of methylated genomic DNA of the gene in the post-treatment sample compared to the pre-treatment sample indicates that the subject has increased or equivalent tumor load or cancer burden or that the tumor load or cancer burden has not been diminished by the treatment. In a preferred embodiment the invention provides a method for determining the development of tumor load or cancer burden in a subject comprising: a) measuring the pre-treatment level of methylated genomic DNA of a gene, or a fragment thereof, in a biological sample obtained from the subject; b) measuring the post-treatment level of methylated genomic DNA of the gene or a fragment thereof, in a biological sample obtained from the subject; and c) comparing the measured post-treatment level with the measured pre-treatment level of methylated DNA, whereby an increase in the amount of methylated genomic DNA of the gene or the fragment thereof or an equivalent amount of said DNA or the fragment thereof in the post-treatment sample compared to the pre-treatment sample indicates that the subject has increased or equivalent tumor load or cancer burden or that the tumor load or cancer burden has not been diminished by the treatment. In a preferred embodiment of the method, the method comprises steps c) and d) as follows: c) comparing the measured post-treatment level and the measured pre-treatment level of methylated DNA and d) determining based on the result of the comparison of step c) the development of tumor load or cancer burden in a subject, whereby an increase in the amount of methylated genomic DNA of the gene or the fragment thereof or an equivalent amount of said DNA or the fragment thereof in the post-treatment sample compared to the pre-treatment sample indicates that the subject has increased or equivalent tumor load or cancer burden or that the tumor load or cancer burden has not been diminished by the treatment.

The invention provides a method for determining tumor load or cancer burden in a subject comprising comparing the post-treatment level of methylated genomic DNA of a gene or a fragment thereof, in a biological sample obtained from the subject with the pre-treatment level of methylated genomic DNA of the gene or fragment, whereby an increase in the amount of methylated genomic DNA of the gene in the post-treatment sample compared to the pre-treatment sample indicates that the subject has increased or equivalent tumor load or cancer burden or that the tumor load or cancer burden has not been diminished by the treatment. In a preferred embodiment of the method, the method comprises steps c) and d) as follows: c) comparing the measured post-treatment level and the measured pre-treatment level of methylated DNA and d) determining based on the result of the comparison of step c) tumor load or cancer burden in a subject, whereby an increase in the amount of methylated genomic DNA of the gene in the post-treatment sample compared to the pre-treatment sample indicates that the subject has increased or equivalent tumor load or cancer burden or that the tumor load or cancer burden has not been diminished by the treatment.

The level of methylated DNA of the genes of the present invention is generally useful as a marker for properties of a cancer such as aggressiveness or tumor load. A comparison of the levels of methylated DNA taken at different points in time, therefore, indicates independently of ongoing treatment how the properties of the cancer develop over time.

For this reason, the present invention provides a method for monitoring a property of a cancer selected from the group consisting of tumor load, cancer burden, aggressiveness of a cancer and the prognosis of a cancer subject comprising the steps of a) measuring the level of methylated genomic DNA of a gene, or a fragment thereof, in a first biological sample obtained from a subject suffering from cancer; b) measuring the level of methylated genomic DNA of the gene or a fragment thereof in a further biological sample obtained from the subject; and c) comparing the measured levels of methylated DNA in the further sample and the first sample, wherein an increased level of methylated DNA of the gene or the fragment thereof in the further sample indicates that the tumor load, tumor burden or the aggressiveness of the cancer increased or the prognosis of the patient worsened and (ii) a decreased level of methylated DNA of the gene or the fragment thereof in the further sample indicates that the tumor load, tumor burden or the aggressiveness of the cancer decreased or the prognosis of the patient improved.

In a preferred embodiment of the method, the method comprises steps c) and d) as follows: c) comparing the measured levels of methylated DNA in the further sample and the first sample and d) determining based on the result of the comparison of step c) whether the tumor load, tumor burden or the aggressiveness of the cancer increased or decreased or the prognosis of the patient worsened or improved.

The first and second sample can be taken any time provided that the second sample is taken after the first sample. Preferably, the second sample is taken at least 1 month, at least 2 months, at least 3 months, at least 6 months, at least 9 months or at least 12 months after the first sample.

The above-described method for monitoring a property of the cancer is especially suitable for monitoring a patient whose cancer has already been treated before for recurrence and/or progression of the cancer. Thus, in a particularly preferred embodiment of the present invention, the patient is a cancer patient whose treatment apparently cured the cancer. The determination of methylation of the genes of the present invention in at least 2 samples taken at different points in time after treatment can be used to detect a recurrence of the cancer. It is a general problem problem in the field of cancer therapy that a treatment may be apparently effective, i.e. it decreases the tumor burden of the patient below the level which is detectable with the available diagnostic methods, in particular imaging methods. Nevertheless, a few cancer cells may remain despite apparently successful treatment. These cells may proliferate and cause a relapse of the cancer even years after an apparently successful treatment. Therefore, a follow-up of treated patients for some period of time after treatment is good medical practice in order to detect a relapse as early as possible. As the method of the present invention is both sensitive (Septin 9, in particular, may be used to detect early stages of colon carcinoma), easy to perform and non-invasive, it is particularly suited to monitor treated cancer patients during follow-up.

Within an aspect of the methods of the invention, the gene is SEPTIN9 (SEQ ID NO:1) or RASSF2a (SEQ ID NO:16).

Within another aspect of the methods of the invention, the gene is SEPTIN9 (SEQ ID NO:1).

Within another aspect of the methods of the invention, the gene is RASSF2A (SEQ ID NO:16).

In a further preferred embodiment of the invention the above-described methods are based on the measurement of the level of methylated DNA of both SEPTIN9 and RASSF2A.

Within another aspect of the method of the invention, the cancer is selected from the group consisting of: colon cancer; and colorectal cancer. Within an embodiment, the stage of the cancer is Stage I colorectal cancer. Within another embodiment, the stage of the cancer is Stage II colorectal cancer. Within another embodiment, the cancer is Stage III colorectal cancer.

Within another embodiment, the cancer is Stage IV colorectal cancer.

Within another aspect of the methods of the invention, the treatment is selected from the group consisting of: surgery or resection; immunotherapy; radiation; chemotherapy; therapy targeting solid tumors; therapy targeting soft-tissue tumors; and therapy targeting blood cells.

Within another aspect of the methods of the invention, the treatment is localized to the region of cancer/tumor in the subject. Within another aspect of the methods of the invention, the treatment is not localized to the region of cancer/tumor in the subject.

The term "localized treatment" preferably refers to surgical resection of the tumor and/or radiation therapy. The term "not localized treatment" is equivalent to systemic treatment and, preferably, refers to chemotherapy and/or immunotherapy.

Within another aspect of the methods of the invention, the biological sample is selected from the group consisting of: tissue, blood, stool, urine, and lung lavage fluid, breast, prostate, colon, rectum, or a combination of these tissues. Within an embodiment, the sample is serum or plasma. The use of serum or plasma is preferred.

Within another aspect of the methods of the invention, methylated genomic DNA or fragment thereof is measured quantitatively or measured quantitatively in part. Within another aspect of the methods of the invention, methylated genomic DNA or fragment is measured qualitatively or measured qualitatively in part. Within another aspect of the methods of the invention, methylated genomic DNA or fragment is measured quantitatively in part and qualitatively in part or semiquantitativley.

Within another aspect of the methods of the invention, measuring the methylated genomic DNA or fragment comprises contacting genomic DNA from the biological sample with at least one reagent, or series of reagents that distinguishes between methylated and non-methylated CpG dinucleotides within at least one target region of the genomic DNA, wherein the target region comprises, or hybridizes under stringent conditions to a sequence of at least 9, at least 16 or at least 25 contiguous nucleotides of SEQ ID NOs: 1, 2, 3 or 16 wherein said contiguous nucleotides comprise at least one CpG dinucleotide sequence. Within an embodiment, contacting the genomic DNA, or the fragment thereof in b), comprises use of a reagent selected from the group comprising of bisulfate, hydrogen sulfite, disulfite, and combinations thereof.

Within another aspect of the methods of the invention comprise: a) extracting or otherwise isolating the genomic DNA or fragment thereof from the biological samples; b) treating the extracted or isolated genomic DNA or a fragment thereof with one or more reagents to convert cytosine bases that are unmethylated in the 5-position thereof to uracil or to another base that is detectably dissimilar to cytosine in terms of hybridization properties; c) contacting the treated genomic DNA or treated fragment, with an amplification enzyme and at least one primer comprising, a contiguous sequence of at least 9, at least 10, at least 11, at least 12, at least 13, at least 14, at least 15, at least 16, at least 17, at least 19, at least 20, at least 25, or at least 50 nucleotides that is complementary to, or hybridizes under moderately stringent or stringent conditions to a the treated sequence or to a complement thereof, wherein the treated genomic DNA or the fragment thereof is either amplified to produce at least one amplificate, or is not amplified; and d) determining, based on a presence, absence or amount of, or on a property of said amplificate, the methylation state or level of at least one CpG dinucleotide of the gene, or an average, or a value reflecting an average methylation state or level of a plurality of CpG dinucleotides of the gene. The treated genomic DNA referred to above is preferably selected from the group consisting of SEQ ID NO: 4, 5, 6, 7, 8, 9, 10, 11, 12, 13, 14, 15, 17, 18, 19 and 20.

Within another aspect of the methods of the invention comprises a) extracting or otherwise isolating the genomic DNA or fragment thereof from the biological samples; b) digesting the extracted or isolated genomic DNA or a fragment thereof with one or more methylation sensitive restriction enzymes; c) contacting the DNA restriction enzyme digest of b), with an amplification enzyme and at least two primers suitable for the amplification of a sequence comprising at least one CpG dinucleotide of the gene; and d) determining, based on a presence, absence or class of an amplificate the methylation state or level of at least one CpG dinucleotide of the gene.

Further information on preferred methods for measuring the level of a methylated genomic DNA can be found further below in the application. In an especially preferred embodiment of the present invention the method for measurement of methylation levels of genomic DNA is MethyLight™, HeavyMethI™ or methylation specific PCR.

Within another aspect the invention provides a methylated genomic SEPTIN9 nucleic acid or a fragment comprising at at least 9, at least 10, at least 11, at least 12, at least 13, at least 14, at least 15, at least 16, at least 17, at least 19, at least 20, at least 25, or at least 50 contiguous nucleotides of the nucleic acid and sequences complementary thereto for use in the determination of prognosis of a cancer subject. Another embodiment of the present invention provides a methylated genomic RASSF2A nucleic acid or a fragment comprising at least 9, at least 16, at least 25, or at least 50 contiguous nucleotides of the nucleic acid and sequences complementary thereto for use in the determination of prognosis of a cancer subject. Within an embodiment the subject has is colorectal cancer.

Within another aspect the invention provides the use of methylated genomic SEPTIN9 nucleic acid or a fragment comprising at least 9, at least 16, at least 25, or at least 50 contiguous nucleotides of the nucleic acid and sequences complementary thereto for determining the prognosis of a cancer subject. Within an embodiment, the subject has colorectal cancer.

Within another aspect the invention provides a bisulfite treated genomic SEPTIN9 or RASSF2A DNA nucleic acid comprising at at least 9, at least 10, at least 11, at least 12, at least 13, at least 14, at least 15, at least 16, at least 17, at least 19, at least 20, at least 25, or at least 50 contiguous nucleotides, or a complement thereto for use in determining the prognosis of a cancer subject. Preferably, the sequence of the bisulfite treated SEPTIN9 or RASSF2A DNA is defined by SEQ ID NO: 4, 5, 6, 7, 8, 9, 10, 11, 12, 13, 14, 15, 17, 18, 19 or 20. Within an embodiment, the contiguous base sequence comprises at least one CpG, TpG or CpA dinucleotide sequence.

Within another aspect the invention provides a kit for determining the prognosis of a cancer subject, determining medical treatment for a cancer subject, for determining if a tumor from a cancer subject indicates that the tumor is aggressive or has metastatic potential or indicates a reduced survival time for the subject, for detecting an aggressive form of cancer in a subject, for selecting a cancer subject for cancer treatment, or for determining tumor load or cancer burden in a subject comprising: a) a plurality of oligonucleotides or polynucleotides able to hybridise under stringent or moderately stringent conditions to the transcription products of the gene or methylated genomic DNA; and b) means to detect the hybridisation. Within an embodiment, the gene or methylated genomic DNA is SEPTIN9. Within an embodiment, the gene or methylated genomic DNA is RASSF2A.

Within another aspect the invention provides a kit for determining the prognosis of a cancer subject, determining medical treatment for a cancer subject, for determining if a tumor from a cancer subject indicates that the tumor is aggressive or has metastatic potential or indicates a reduced survival time for the subject, for detecting an aggressive form of cancer in a subject, for selecting a cancer subject for cancer treatment, or for determining tumor load or cancer burden in a subject comprising: (a) a bisulfate reagent; (b) at least one set of oligonucleotides containing two oligonucleotides whose sequences in each case are identical, are complementary, or hybridize under stringent or highly stringent conditions to a at at least 9, at least 10, at least 11, at least 12, at least 13, at least 14, at least 15, at least 16, at least 17, at least 19, at least 20, at least 25, or at least 50 nucleotide long segment of a SEPTIN9 sequence or of a RASSF2A gene.

Within other aspects the invention provides the use of the methods described herein, the nucleic acids as described herein and/or a kit as described herein for determining the prognosis of a cancer subject.

The present invention provides a method for determining the prognosis of a subject having cancer, in a subject comprising determining the expression levels of at least one gene or genomic sequence wherein the genomic sequence is methylated in cancers and unmethylated in non-cancerous tissues. Methylation of the genomic DNA encoding a gene or, in particular, methylation of its promoter region decreases the expression of said gene. Consequently, methylation of the gene in question gives a similar diagnostic information as its underexpression. Thus, the level or amount of methylation/or expression of the gene in a biological sample isolated from said subject is indicative of the prognosis of said subject. Various aspects of the present invention provide genetic markers, whereby expression analysis of said marker enables the determination of the prognosis of a subject having cancer. In one embodiment said expression level is determined by detecting the presence, absence or level of mRNA transcribed from said gene. In a further embodiment said expression level is determined by detecting the presence, absence or level of a polypeptide encoded by said gene or sequence thereof.

The present invention provides a method for determining the prognosis of a subject having colorectal cancer (CRC) or colon cancer, in a subject comprising determining the DNA Methylation levels of Septin 9 (Septin9) or of RASSF2A in plasma isolated from said subject wherein after resection of the primary tumor the methylation status is indicative of the prognosis of said subject. In an embodiment the resection is curative.

The examples described herein showed that the Septin9 biomarker decreases in approximately 73% of the investigated CRC Stage II and only in 20% of the Stage III patients after resection of the primary tumor. The presence of Septin9 in CRC patients after treatment with curative intention can be used an early prognostic indicator of disease recurrence. The fact that Septin9 is still detectable after resection of the primary tumor, indicates a high risk of the presence of tumor cells (e.g. micro metastasis) that are still in the body of the patient and which can be sensitive detected by Septin9.

In further embodiments said expression is determined by detecting the presence, absence or amount of CpG methylation within said gene, and therefrom deducing the prognosis of said subject having cancer. Said method comprises the following steps: i) contacting genomic DNA isolated from a biological sample obtained from the subject with at least one reagent, or series of reagents that distinguishes between methylated and non-methylated CpG dinucleotides within at least one target region of the genomic DNA, wherein the nucleotide sequence of said target region comprises at least one CpG dinucleotide sequence of at least one gene or genomic sequence of this group of genes and ii) determining the prognosis of a subject having cancer. Preferably the target region comprises, or hybridizes under stringent conditions to a sequence of at least 16, at least 25 or at least 50 contiguous nucleotides.

Said use of the gene may be enabled by means of any analysis of the expression of the gene, by means of mRNA expression analysis or protein expression analysis. In an embodiment the determination of the prognosis of a subject having cancer, is enabled by means of analysis of the methylation status of at least one gene or genomic sequence that is methylated in cancer tissue but unmethylated in non-cancerous tissue, including isoforms, fragments, promoter or regulatory elements, and antisense versions thereof.

The invention provides a method for the analysis of biological samples for features associated with the progression of cancer, the method characterized in that the nucleic acid, or a fragment thereof is contacted with a reagent or series of reagents capable of distinguishing between methylated and non methylated CpG dinucleotides within the genomic sequence. In an embodiment, the gene is SEPTIN9 or RASSF2A.

Preferably, the sequence of SEPTIN9 is defined by SEQ ID NO: 1, 2 or 3. More preferably, the sequence of SEPTIN9 is defined by SEQ ID NO: 2 or 3.

The sequence of RASSF2A is, preferably, defined by SEQ ID NO: 16.

In a preferred embodiment of the present invention the methylation status of the promotor region of SEPTIN9 and/or RASSF2A ist determined. In a more preferred embodiment, the methylation state of at least one cytosine comprised by the genomic sequence as defined by SEQ ID NO: 32 and/or 34 is determined. In an even more preferred embodiment of the invention, the methylation status of at least one cytosine selected from the group consisting of the cytosines in positions 21, 28, 30, 37 and 39 of SEQ ID NO: 32 and positions 25, 29, 46, 52, 58, 70, 74, 79 and 89 of SEQ ID NO: 34 is determined. In the most preferred embodiment, the methylation status of all aforementioned cytosine positions in SEQ ID NO: 32 and/or 34 is determined.

The present invention provides a method for ascertaining epigenetic parameters of genomic DNA associated with the development of cancer.

The source of the test sample is a tissue, or body fluid, such as, for example, tissues and body fluids selected from the group consisting of tissue, blood, plasma, serum, urine, lung lavage fluid, stool, lung, breast, colon, rectum, intestine and combinations thereof.

Specifically, the present invention provides a method for determining the prognosis of a subject having cancer suitable for use in a prognostic tool, comprising: obtaining a biological sample comprising genomic nucleic acid(s); contacting the nucleic acid(s), or a fragment thereof, with a reagent or a plurality of reagents sufficient for distinguishing between methylated and non methylated CpG dinucleotide sequences within a target sequence of the subject nucleic acid, wherein the target sequence comprises, or hybridises under stringent conditions to, a sequence comprising at least 16, at least 25 or at least 50 contiguous nucleotides of the gene said contiguous nucleotides comprising at least one CpG dinucleotide sequence; and determining, based at least in part on said distinguishing, the methylation state of at least one target CpG dinucleotide sequence, or an average, or a value reflecting an average methylation state of a plurality of target CpG dinucleotide sequences.

In distinguishing between methylated and non methylated CpG dinucleotide sequences within the target sequence comprises methylation state-dependent conversion or non-conversion of at least one such CpG dinucleotide sequence to the corresponding converted or non-converted dinucleotide sequence within a sequence selected from the group consisting of bisulfite converted sense and antisense strands of the genes and contiguous regions thereof corresponding to the target sequence.

Additional embodiments provide a method for the determination of the prognosis of a subject having cancer comprising: obtaining a biological sample having subject genomic DNA; extracting the genomic DNA; treating the genomic DNA, or a fragment thereof, with one or more reagents to convert 5-position unmethylated cytosine bases to uracil or to another base that is detectably dissimilar to cytosine in terms of hybridization properties; contacting the treated genomic DNA, or the treated fragment thereof, with an amplification enzyme and at least two primers comprising, in each case a contiguous sequence at least 9 nucleotides in length that is complementary to, or hybridizes under moderately stringent or stringent conditions to a sequence selected from the group consisting bisulfite converted sense and antisense strands, and complements thereof, wherein the treated DNA or the fragment thereof is either amplified to produce an amplificate, or is not amplified; and determining, based on a presence, absence or class of, or on a property of said amplificate, the methylation state or an average, or a value reflecting an average of the methylation level of at least one, but more preferably a plurality of CpG dinucleotides of the genomic sequences.

The methods described herein comprise use of at least one method selected from the group consisting of: i) hybridizing at least one nucleic acid molecule comprising a contiguous sequence at least 9, at least 25 or at least 50 nucleotides in length that is complementary to, or hybridizes under moderately stringent or stringent conditions to a sequence selected from the group consisting of bisulfite converted sense and antisense strands, and complements thereof; ii) hybridizing at least one nucleic acid molecule, bound to a solid phase, comprising a contiguous sequence at least 9 nucleotides at least 25 or at least 50 in length that is complementary to, or hybridizes under moderately stringent or stringent conditions to a sequence selected from the group consisting of bisulfite converted sense and antisense strands, and complements thereof; iii) hybridizing at least one nucleic acid molecule comprising a contiguous sequence at least 9, at least 25 or at least 50 nucleotides in length that is complementary to, or hybridizes under moderately stringent or stringent conditions to a sequence selected from the group consisting of bisulfite converted sense and antisense strands, and complements thereof, and extending at least one such hybridized nucleic acid molecule by at least one nucleotide base; and iv) sequencing of the amplificate.

Further embodiments provide a method for the analysis (i.e. determining disease progression and/or patient prognosis) of a cancer, comprising: obtaining a biological sample having subject genomic DNA; extracting the genomic DNA; contacting the genomic DNA, or a fragment thereof, comprising one or more sequences selected from the group consisting of the genomic sequences or a sequence that hybridizes under stringent conditions thereto, with one or more methylation-sensitive restriction enzymes, wherein the genomic DNA is either digested thereby to produce digestion fragments, or is not digested thereby; and determining, based on a presence, absence or class of, or on property of at least one such fragment, the methylation state of at least one CpG dinucleotide sequence of the genomic sequences or an average, or a value reflecting an average methylation state of a plurality of CpG dinucleotide sequences thereof. The digested or undigested genomic DNA can be amplified prior to said determining. Additional embodiments provide novel genomic and chemically modified nucleic acid sequences, as well as oligonucleotides and/or PNA-oligomers for analysis of cytosine methylation patterns within the genomic sequences.

BRIEF DESCRIPTION OF THE DRAWINGS

In FIGS. 1 and 3 Stage I: dotted line and circles, Stage II: dashed line and triangle, Stage III: dashed/dotted line and crosses and Stage IV: closed line and rhombi.

FIG. 5: Stage I (4 patients): dotted line and circles; stage II (9 patients): dashed line and triangle; Stage III (4 patients): dashed/dotted line and crosses; Stage IV (2 patients): closed line and rhombus.

FIG. 5: Stage I (4 patients): dotted line and circles; stage II (9 patients): dashed line and triangle; Stage III (4 patients): dashed/dotted line and crosses; Stage IV (2 patients): closed line and rhombus.

DETAILED DESCRIPTION OF THE INVENTION

Definitions

Figure 1:
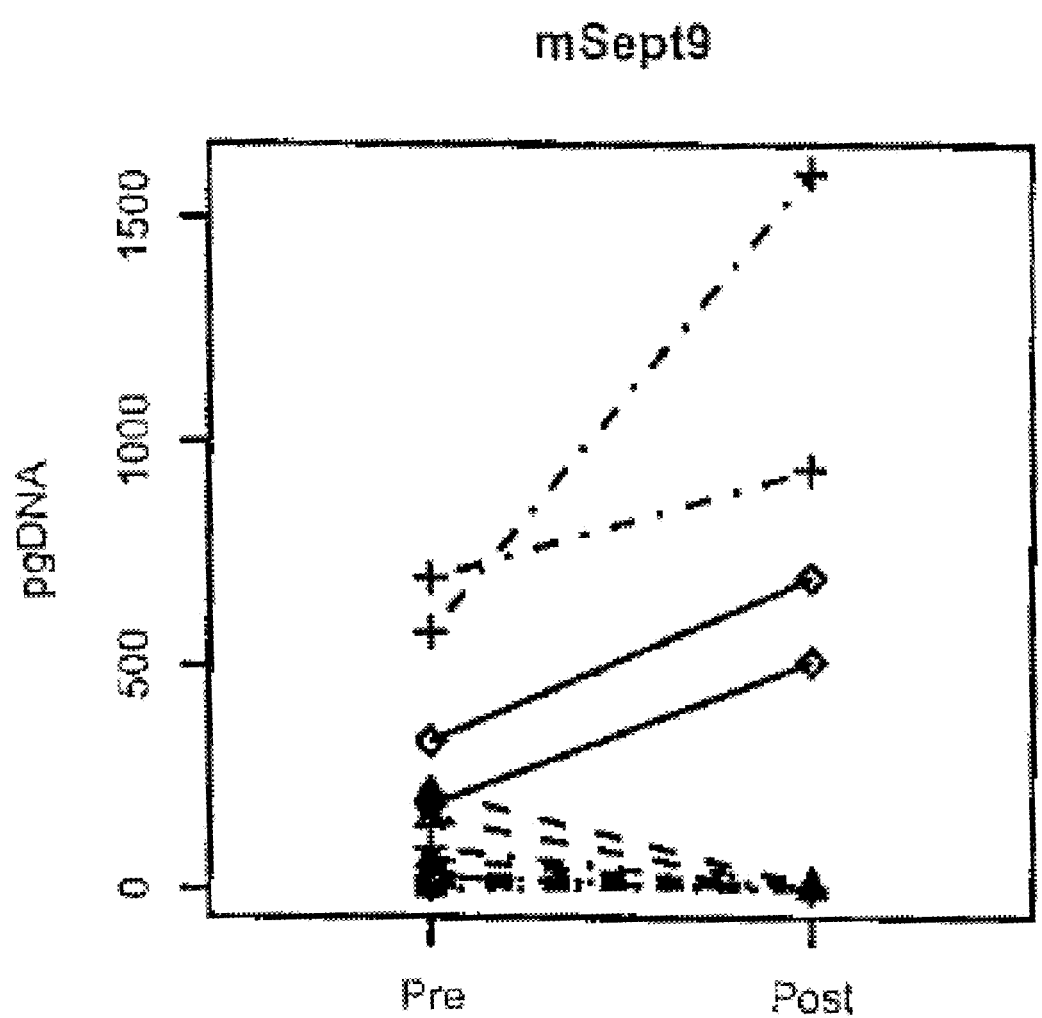
FIGS. 1-4 show Boxplots of ratios of Septin9 DNA post/pre surgery (pg methylated Sept9 DNA post surgery divided pg methylated Sept9 DNA pre surgery) in colorectal cancer patients sorted by cancer stage (x-axis). Ratios were only plotted for patients showing Septin9 DNA levels>0 pre surgery. The four numbers on top of the plot are p-values from one sided t-tests using levels post versus pre surgery paired by patients.
Figure 2:
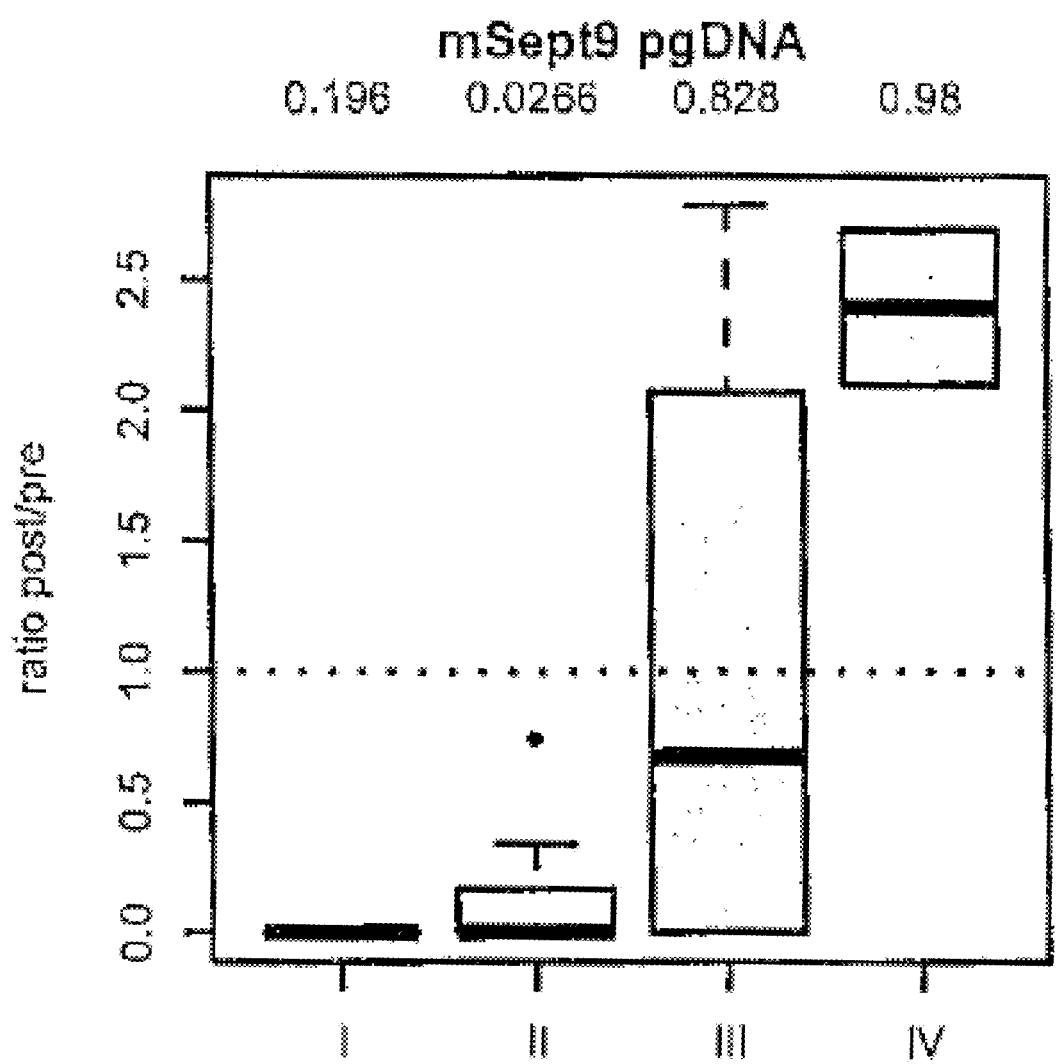
Figure 3:
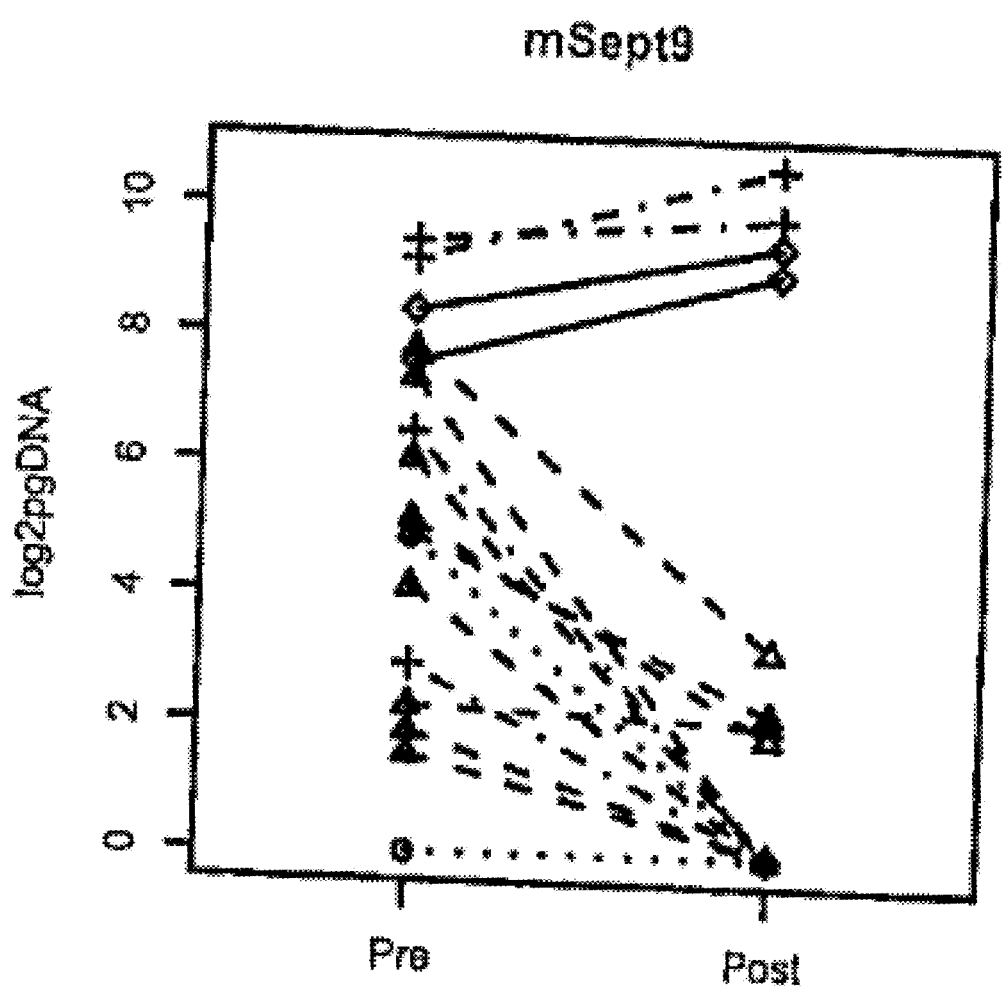
Figure 4:
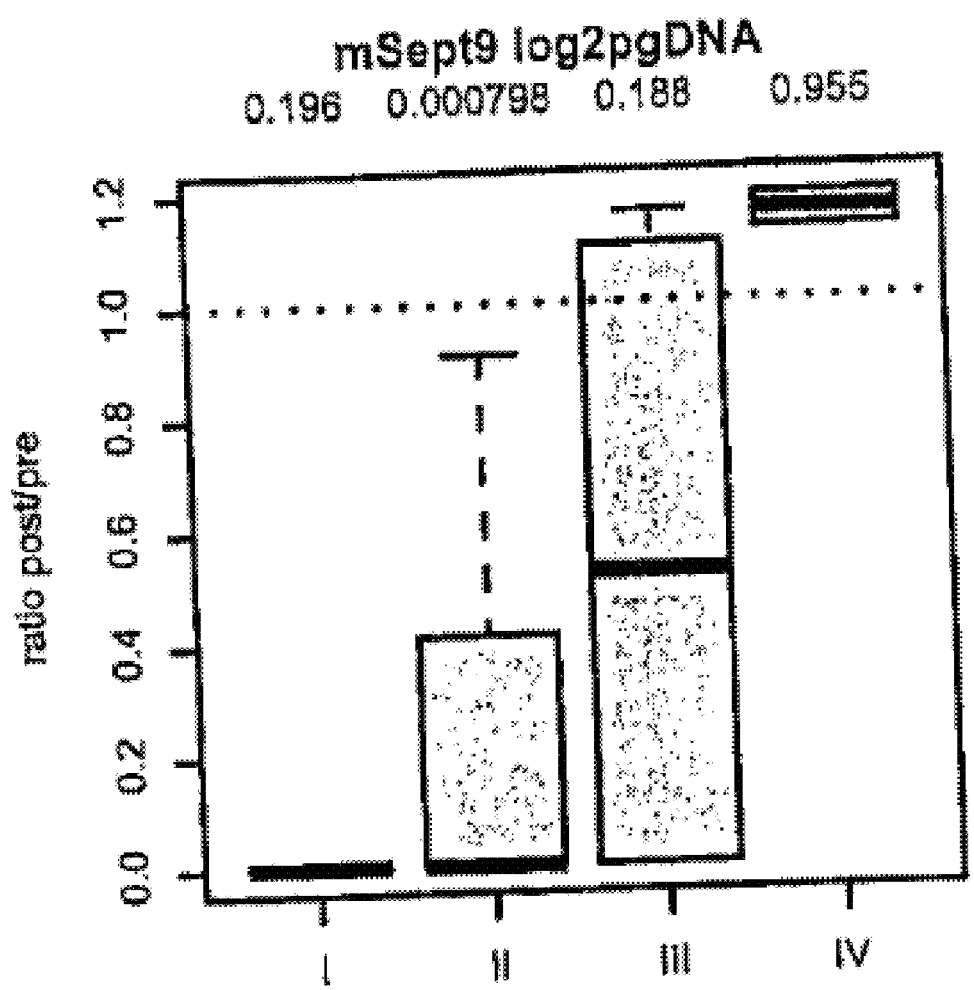
Figure 5:
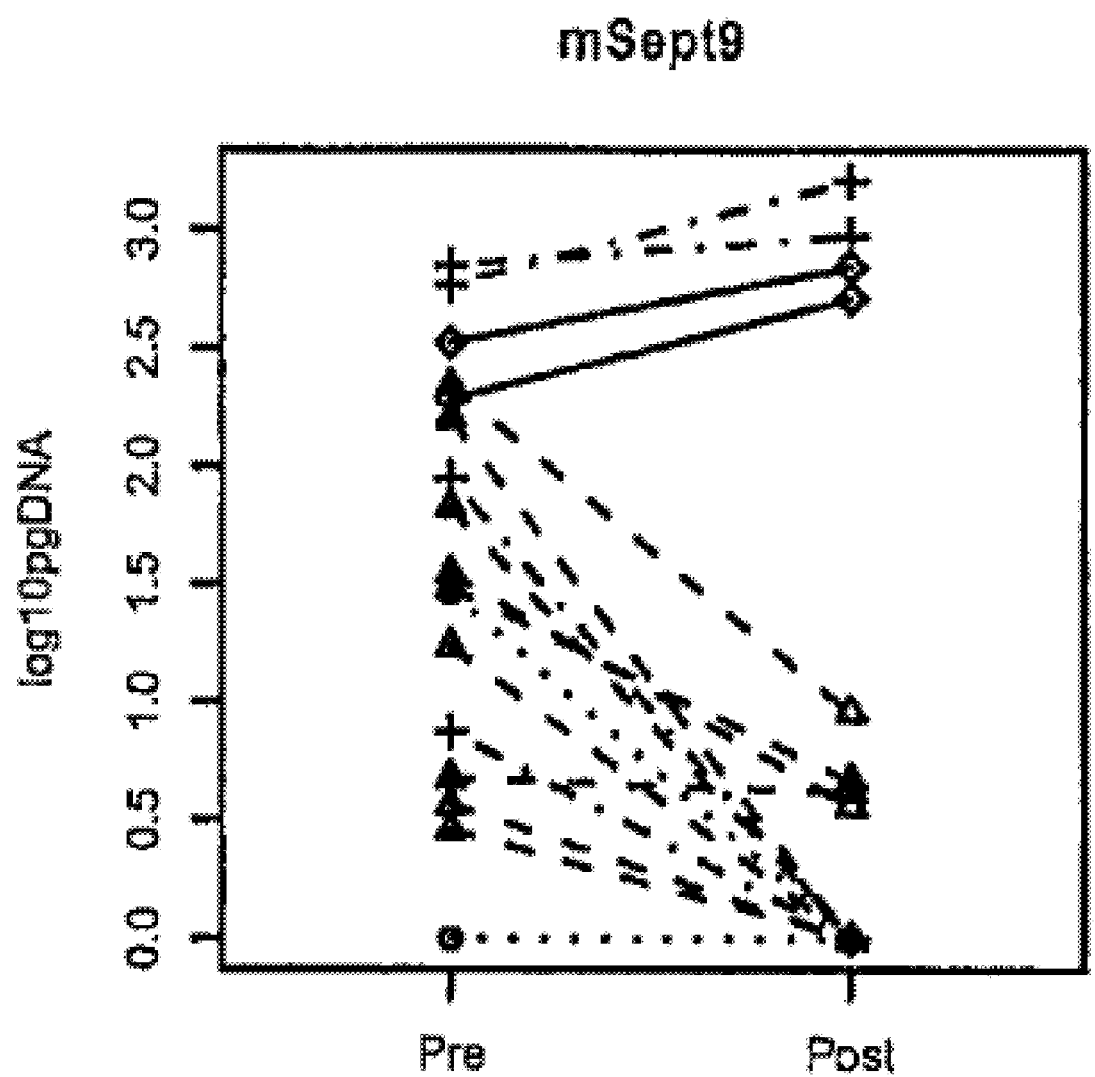
FIGS. 5 and 6 show levels of Septin9 DNA (y-axis: log 10 of pg methylated Sept9 DNA) in colorectal cancer patients pre and post surgery (x-axis). The different stages of the cancer were visualized as follows.
Figure 6:
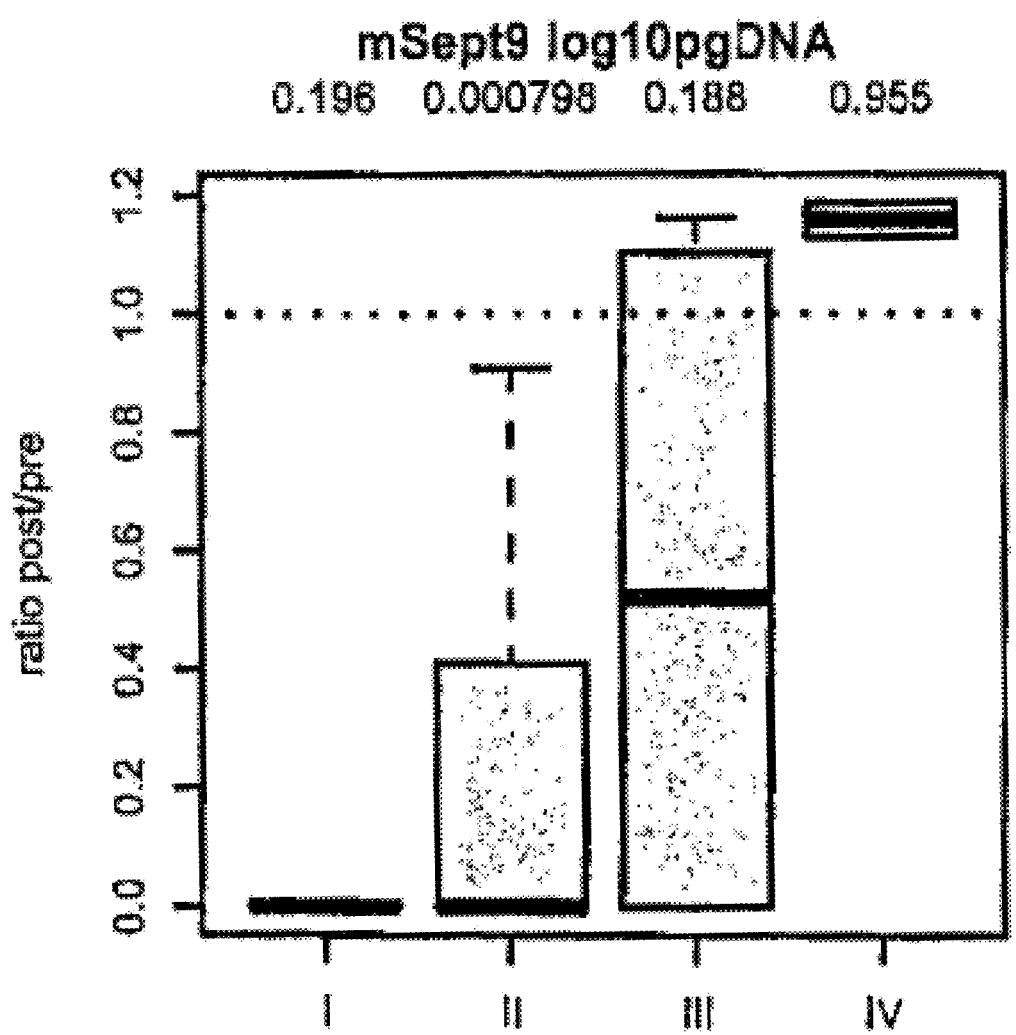
Figure 7:
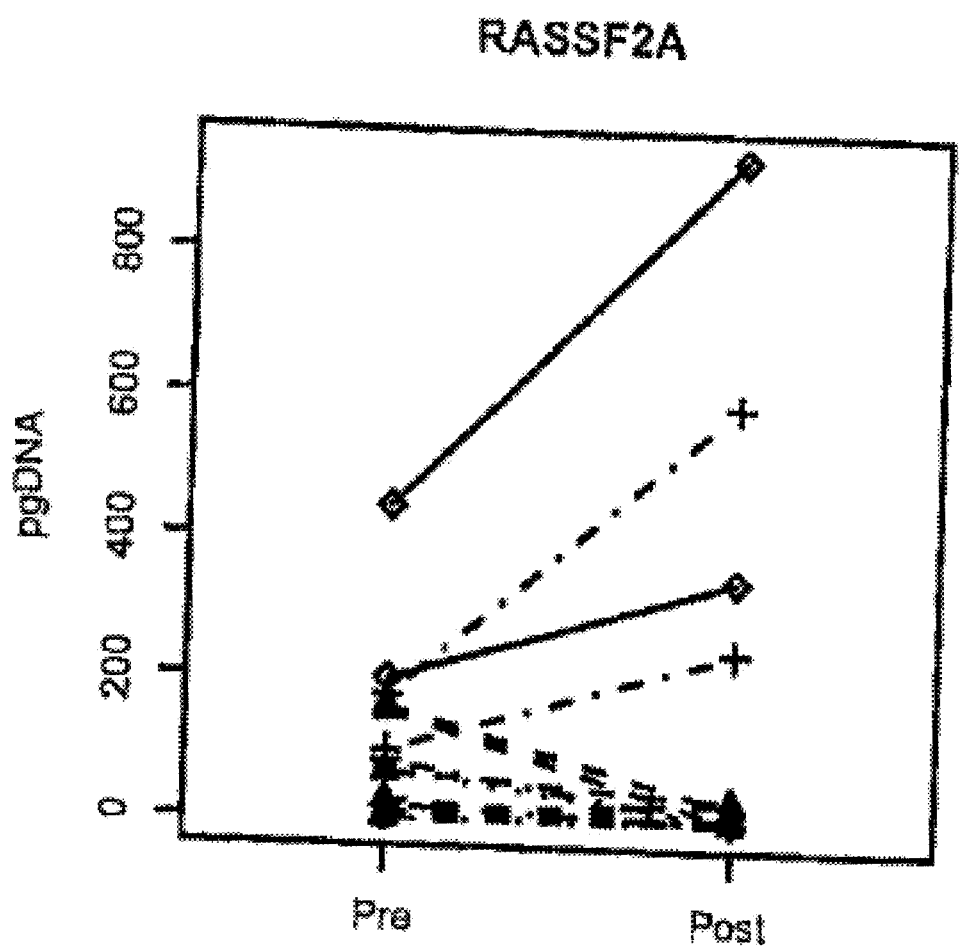
FIGS. 7 and 8 show Boxplots of ratios of RASSF2A DNA post/pre surgery (pg methylated Sept9 DNA post surgery divided pg methylated RASSF2A DNA pre surgery) in colorectal cancer patients sorted by cancer stage (x-axis). Ratios were only plotted for patients showing RASSF2A DNA levels>0 pre surgery. The four numbers on top of the plot are p-values from one sided paired t-tests using levels post versus pre surgery paired by patients.
Figure 8:
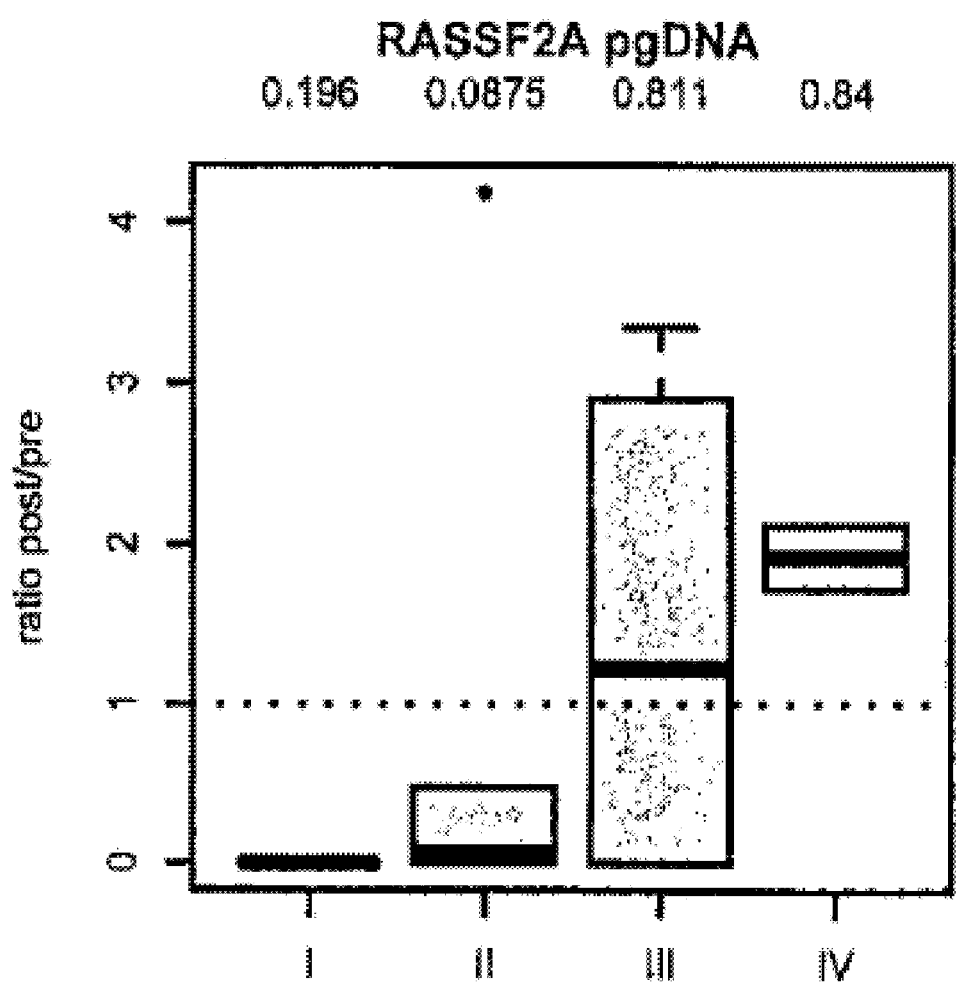
Figure 9:
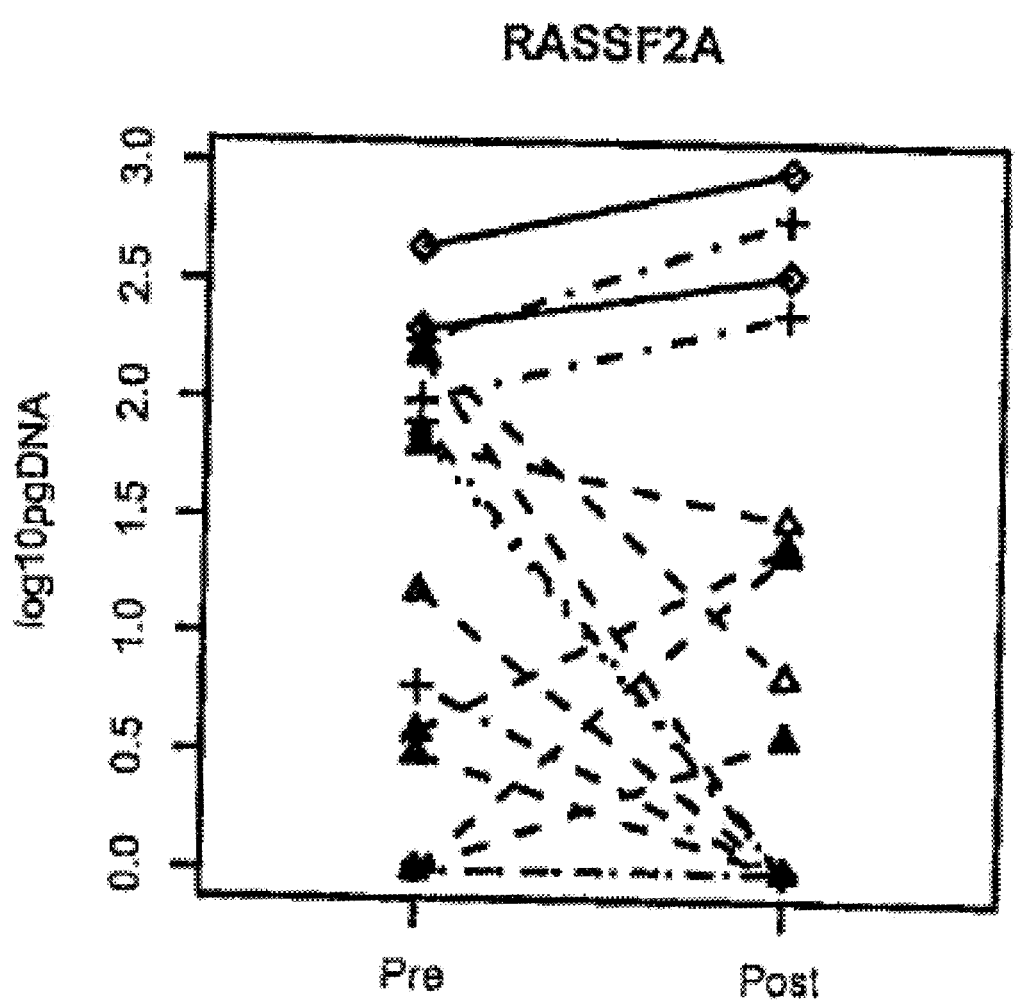
FIGS. 9-12 show levels of methylted RASSF2A DNA (y-axis: log 10 of pg methylated RASSF2A DNA) in colorectal cancer patients pre and post surgery (as given on the x-axis). The different stages of the cancer were visualized as follows. Stage I (4 patients): dotted line and circles; stage II (9 patients): dashed line and triangle; Stage III (4 patients): dashed/dotted line and crosses; Stage IV (2 patients): closed line and rhombus.
Figure 10:
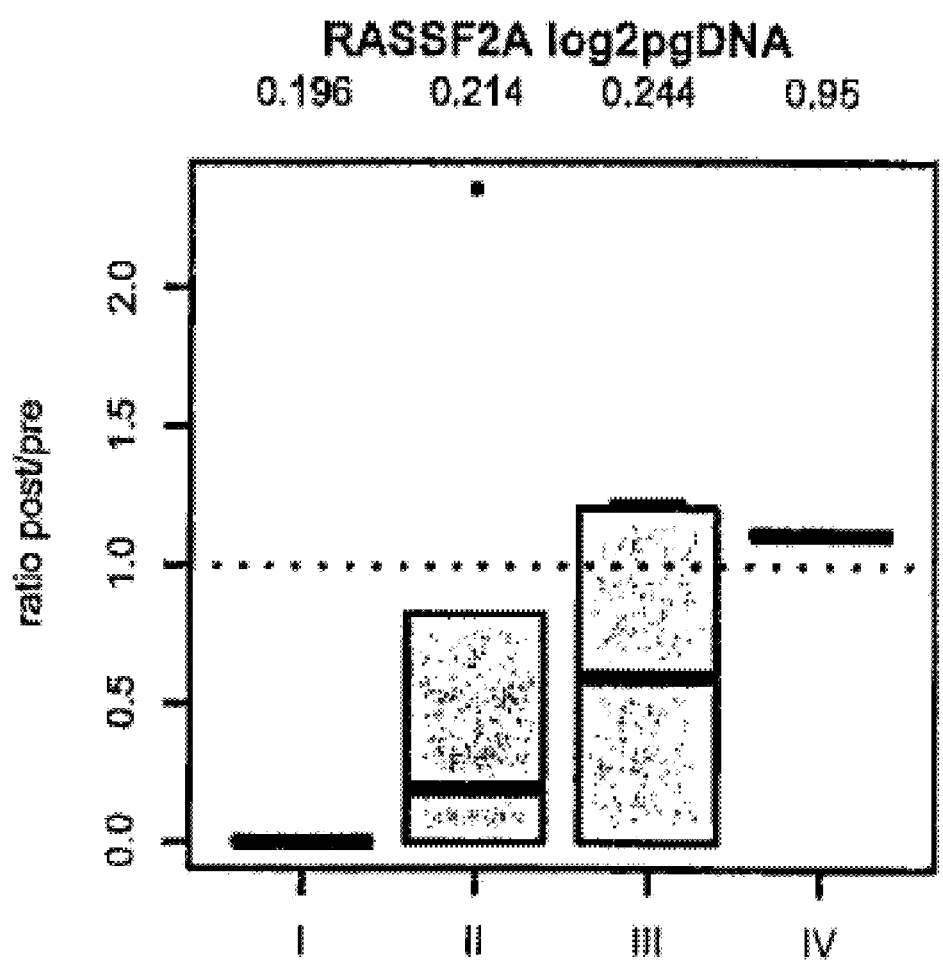
Figure 11:
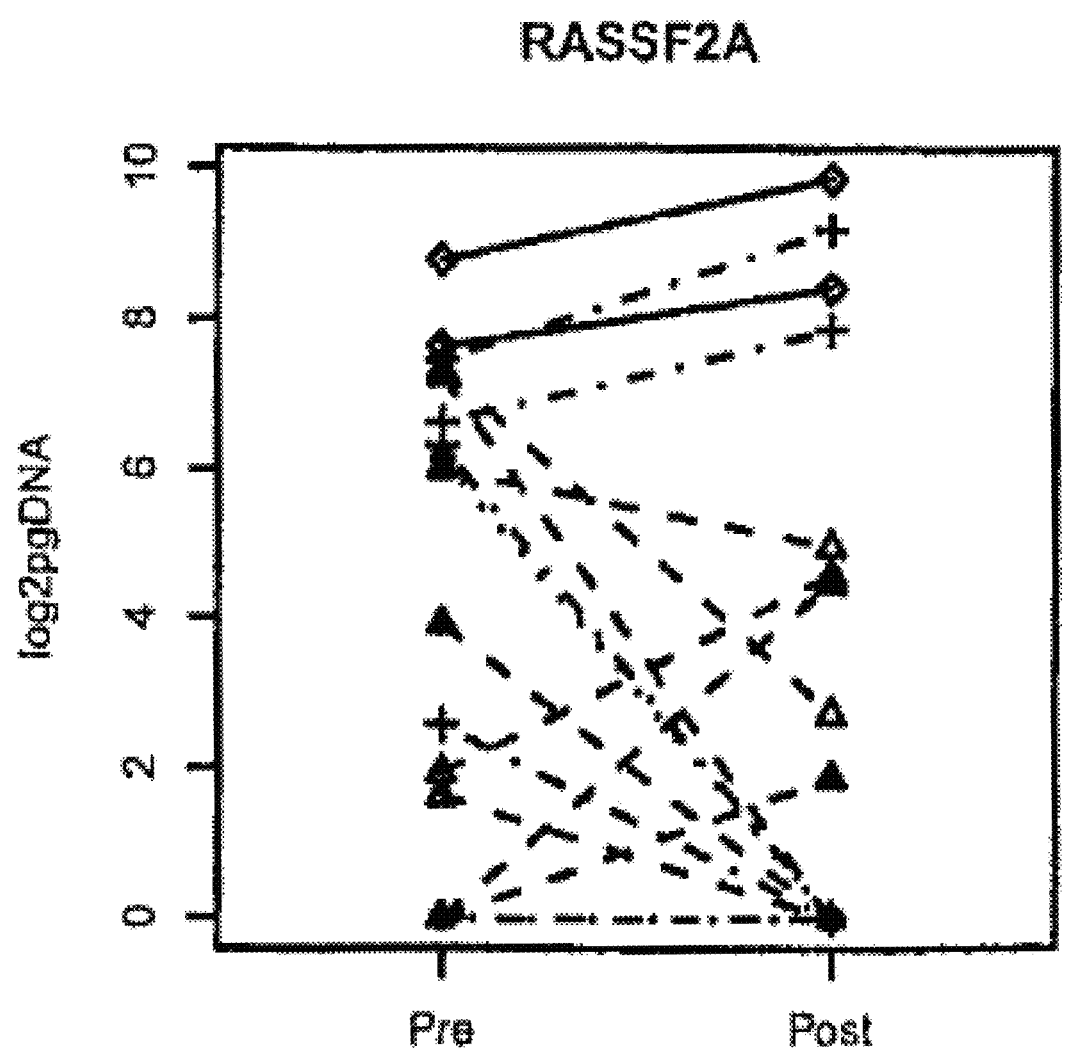
Figure 12:
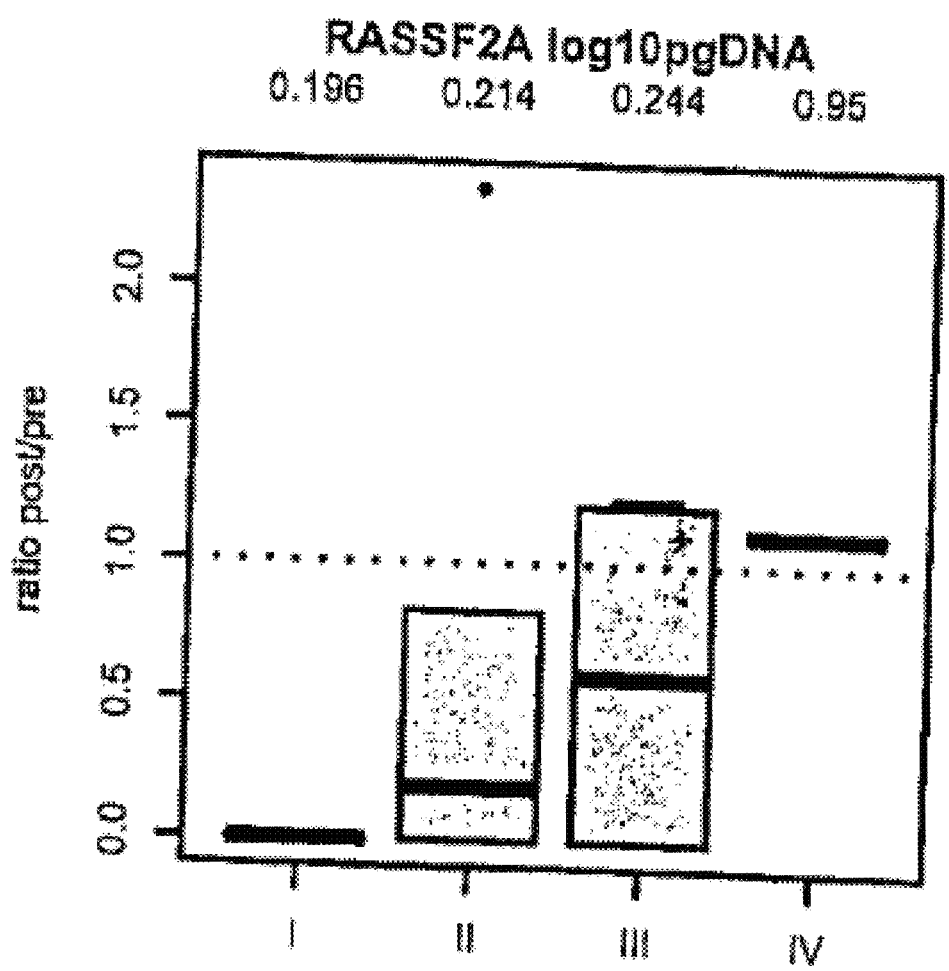

The term "Observed/Expected Ratio" ("O/E Ratio") refers to the frequency of CpG dinucleotides within a particular DNA sequence, and corresponds to the [number of CpG sites/(number of C bases×number of G bases)]/band length for each fragment.

The term "CpG island" refers to a contiguous region of genomic DNA that satisfies the criteria of (1) having a frequency of CpG dinucleotides corresponding to an "Observed/Expected Ratio" >0.6, and (2) having a "GC Content" >0.5. CpG islands are typically, but not always, between about 0.2 to about 1 KB, or to about 2 kb in length.

The term "methylation state" or "methylation status" refers to the presence, absence or class of 5-methylcytosine ("5-mCyt") at one or a plurality of CpG dinucleotides within a DNA sequence. Methylation states at one or more particular CpG methylation sites (each having two CpG dinucleotide sequences) within a DNA sequence include "unmethylated," "fully-methylated" and "hemi-methylated."

The term "hemi-methylation" or "hemimethylation" refers to the methylation state of a double stranded DNA wherein only one strand thereof is methylated.

The term 'AUC' as used herein is an abbreviation for the area under a curve. In particular it refers to the area under a Receiver Operating Characteristic (ROC) curve. The ROC curve is a plot of the true positive rate against the false positive rate for the different possible cut points of a diagnostic test. It shows the trade-off between sensitivity and specificity depending on the selected cut point (any increase in sensitivity will be accompanied by a decrease in specificity). The area under an ROC curve (AUC) is a measure for the accuracy of a test (the larger the area the better, optimum is 1, a random test would have a ROC curve lying on the diagonal with an area of 0.5; for reference: J. P. Egan. Signal Detection Theory and ROC Analysis, Academic Press, New York, 1975).

The term "microarray" refers broadly to both "DNA microarrays," and 'DNA chip(s),' as recognized in the art, encompasses all art-recognized solid supports, and encompasses all methods for affixing nucleic acid molecules thereto or synthesis of nucleic acids thereon.

"Genetic parameters" are mutations and polymorphisms of genes and sequences further required for their regulation. To be designated as mutations are, in particular, insertions, deletions, point mutations, inversions and polymorphisms and, particularly preferred, SNPs (single nucleotide polymorphisms).

"Epigenetic parameters" are, in particular, cytosine methylation. Further epigenetic parameters include, for example, the acetylation of histones which, however, cannot be directly analysed using the described method but which, in turn, correlate with the DNA methylation.

The term "bisulfite reagent" refers to a reagent comprising bisulfite, disulfite, hydrogen sulfite or combinations thereof, useful as disclosed herein to distinguish between methylated and unmethylated CpG dinucleotide sequences.

The term "Methylation assay" refers to any assay for determining the methylation state of one or more CpG dinucleotide sequences within a sequence of DNA.

The term "MS.AP-PCR" (Methylation-Sensitive Arbitrarily-Primed Polymerase Chain Reaction) refers to the art-recognized technology that allows for a global scan of the genome using CG-rich primers to focus on the regions most likely to contain CpG dinucleotides, and described by Gonzalgo et al., *Cancer Research* 57:594-599, 1997.

The term "MethyLight™" refers to the art-recognized fluorescence-based real-time PCR technique described by Eads et al., *Cancer Res.* 59:2302-2306, 1999.

The term "HeavyMethyl™" assay, in the embodiment thereof implemented herein, refers to an assay, wherein methylation specific blocking probes (also referred to herein as blockers) covering CpG positions between, or covered by the amplification primers enable methylation-specific selective amplification of a nucleic acid sample.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers.

The term "Ms-SNuPE" (Methylation-sensitive Single Nucleotide Primer Extension) refers to the art-recognized assay described by Gonzalgo & Jones, *Nucleic Acids Res.* 25:2529-2531, 1997.

The term "MSP" (Methylation-specific PCR) refers to the art-recognized methylation assay described by Herman et al. *Proc. Natl. Acad. Sci. USA* 93:9821-9826, 1996, and by U.S. Pat. No. 5,786,146.

The term "COBRA" (Combined Bisulfite Restriction Analysis) refers to the art-recognized methylation assay described by Xiong & Laird, *Nucleic Acids Res.* 25:2532-2534, 1997.

The term "MCA" (Methylated CpG Island Amplification) refers to the methylation assay described by Toyota et al., *Cancer Res.* 59:2307-12, 1999, and in WO 00/26401A1.

The term "hybridisation" is to be understood as a bond of an oligonucleotide to a complementary sequence along the lines of the Watson-Crick base pairings in the sample DNA, forming a duplex structure.

"Stringent hybridisation conditions," as defined herein, involve hybridising at 68° C. in 5×SSC/5×Denhardt's solution/1.0% SDS, and washing in 0.2×SSC/0.1% SDS at room temperature, or involve the art-recognized equivalent thereof (e.g., conditions in which a hybridisation is carried out at 60° C. in 2.5×SSC buffer, followed by several washing steps at 37° C. in a low buffer concentration, and remains stable). Moderately stringent conditions, as defined herein, involve including washing in 3×SSC at 42° C., or the art-recognized equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley & Sons, N.Y.) at Unit 2.10.

The terms "Methylation-specific restriction enzymes" or "methylation-sensitive restriction enzymes" shall be taken to mean an enzyme that selectively digests a nucleic acid dependant on the methylation state of its recognition site. In the case of such restriction enzymes which specifically cut if the recognition site is not methylated or hemimethylated, the cut will not take place, or with a significantly reduced efficiency, if the recognition site is methylated. In the case of such restriction enzymes which specifically cut if the recognition site is methylated, the cut will not take place, or with a significantly reduced efficiency if the recognition site is not methylated. Preferred are methylation-specific restriction enzymes, the recognition sequence of which contains a CG dinucleotide (for instance cgcg or cccggg). Further preferred for some embodiments are restriction enzymes that do not cut if the cytosine in this dinucleotide is methylated at the carbon atom C5.

"Non-methylation-specific restriction enzymes" or "non-methylation-sensitive restriction enzymes" are restriction enzymes that cut a nucleic acid sequence irrespective of the methylation state with nearly identical efficiency. They are also called "methylation-unspecific restriction enzymes."

In reference to composite array sequences, the phrase "contiguous nucleotides" refers to a contiguous sequence region of any individual contiguous sequence of the composite array, but does not include a region of the composite array sequence that includes a "node," as defined herein above.

The description of a biomarker that is methylated in cancer, but unmethylated in non-cancerous tissue as a prognostic indicator of cancer shall be taken to include all transcript variants thereof and all promoter and regulatory elements thereof. Furthermore as a plurality of SNPs are known within the biomarker or gene the term shall be taken to include all sequence variants thereof.

Overview:

The present invention provides a method for determining the prognosis of a subject having cancer, comprising determining the methylation and/or expression levels of at least one biomarker that is methylated in cancer, but unmethylated in non-cancerous tissue in a biological sample isolated from said subject wherein methylation and/or expression status is indicative of the prognosis of said subject having cancer.

Methods for determining the prognosis, and thus the methods and agents for treatment of a cancer patient include determining the staging of the tumor based on various criteria. Often this determination includes invasive procedures to observe histological changes in tissue morphology and level of invasion of the tumor into neighboring tissue and metastasis. Various cancer staging or classification methods are used to evaluate the progression or status of the cancer using standard classification criteria.

In colorectal cancer, two of these staging methods are the Tumor-Node-Metastais (TNM) staging (Stages I-IV) as developed by the American Joint Committee on Cancer (AJCC Cancer Staging Manual, 6th Edition, Springer-Verlag, New York, 2002), incorporated herein for reference, and the modified Duke's or Astler-Coller staging system (Stages A-D) (Astler V B, Coller F A., Ann Surg 1954; 139:846-52). Both methods relate measures of the spread of the primary tumor through layers of colon or rectal wall to the adjacent organs, lymph nodes and distant sites to evaluate tumor progression. Estimates of recurrence risk and treatment decisions in colon cancer are currently based primarily on tumor staging.

The invention provides methods and kits for determining the prognosis of a cancer subject, determining medical treatment for a cancer subject, determining if a tumor from a cancer subject indicates that the tumor is aggressive or has metastatic potential or indicates a reduced survival time for the subject, detecting an aggressive form of cancer in a subject, selecting a cancer subject for cancer treatment, or determining tumor load or cancer burden in a subject comprising determining the methylation and/or expression levels of at least one biomarker that is methylated in cancer, but unmethylated in non-cancerous tissue in a biological sample isolated from said subject wherein methylation and/or expression status is indicative of the prognosis of said subject having cancer. The methods comprise extracting or otherwise isolating the genomic DNA or fragment thereof from the biological samples; treating the extracted or isolated genomic DNA or a fragment thereof with one or more reagents to convert cytosine bases that are unmethylated in the 5-position thereof to uracil or to another base that is detectably dissimilar to cytosine in terms of hybridization properties; contacting the treated genomic DNA or treated fragment, with an amplification enzyme and at least one primer comprising, a contiguous sequence of at least 9, at least 18, at least 25 or at least 50 nucleotides that is complementary to, or hybridizes under moderately stringent or stringent conditions to a the treated sequence or to a complement thereof, wherein the treated genomic DNA or the fragment thereof is either amplified to produce at least one amplificate, or is not amplified; and determining, based on a presence, absence or amount of, or on a property of said amplificate, the methylation state or level of at least one CpG dinucleotide of the gene, or an average, or a value reflecting an average methylation state or level of a plurality of CpG dinucleotides of the gene.

Methods of treating the extracted DNA, amplifying the DNA, and detecting the DNA, and analyzing the DNA are further described herein.

The invention provides the detection in a biological sample isolated from a cancer subject of a biomarker or gene that is methylated in cancer, but unmethylated in non-cancerous tissue, and the further prognosis, determination of clinical outcome, or determination of medical treatment for the cancer subject.

Preferably, the method of the invention comprises the steps of a) measuring the level of methylated genomic DNA of a gene, or a fragment thereof, in a first biological sample obtained from a subject suffering from cancer; b) measuring the level of methylated genomic DNA of the gene or a fragment thereof, in a further biological sample obtained from the subject; and c) comparing the measured levels of methylated DNA in the further sample and the first sample.

In an embodiment, the detection and analysis is performed in a pre-treatment sample and again in a post-treatment sample, wherein the treatment is any treatment of the patient (or patient tissue) with a procedure or administration that would diminish, remove, shrink, minimize or ablate the tumor. Such methods include, but are not limited to, surgical resection, immunotherapy, radiation therapy, chemotherapy, solid tumor targeting therapies, laser therapy, soft tissue targeting therapies, and blood cancer treatments. In this embodiment, the "pre-treatment sample" corresponds to the "first sample" and the "post-treatment-sample" corresponds to the "further sample"

The pre-treatment sample may be taken any time before treatment commences. However, it is preferably taken not more than 1 week, not more than 2 weeks, not more than 4 weeks or not more than 8 weeks before treatment commences. The post-treatment sample is, preferably taken any time after the treatment commences. If the treatment is chemotherapy, it is explicitly envisaged that the post-treatment sample is taken before the patient's course of treatment is completed provided that the patient has received at least one dosage of at least one pharmaceutical compound used for chemotherapy.

The recommended treatment of colon cancer depends on the staging of the tumor. Stages I, II and III are characterized by the absence of distant metastases. Therefore, surgical resection of the tumor is the treatment of choice. For stages II B, II C, III and high risk II A adjuvant chemotherapy may be recommended. For stage IV tumors surgical resection is only recommended if the number and location of distant metastases indicates the chance of a complete cure by removing all tumors. In stage IV disease surgical resection is accompanied by adjuvant and/or neoadjuvant chemotherapy.

In a preferred embodiment of the present invention the tumor is stage I, II or III colon carcinoma. In this case, a level of the methylated genomic DNA in the post-treatment sample which indicates a complete removal of the tumor, preferably a level below the limit of detection, indicates that the treatment of the cancer by surgical resection was successful. This is equivalent to a good prognosis of the patient and adjuvant chemotherapy as additional treatment is, preferably, not recommended.

In another preferred embodiment of the present invention, the treatment is adjuvant or neoadjuvant chemotherapy of a stage I, II or III tumor or an operable stage IV tumor or chemotherapy without additional surgery as systemic treatment of an inoperable stage IV tumor. In this case, a decreased level of the methylated genomic DNA in the post-treatment sample as compared to the pre-treatment sample, preferably, indicates that the selected chemotherapeutic treatment regimen was successful in reducing the tumor burden of the patient. This is equivalent to the indication that the chemotherapeutic treatment regimen does not need to be adapted. However, if the level of the methylated genomic sequence in the post-treatment sample remains constant or even increases, this indicates, preferably, the the current treatment is not successful and the treatment regimen needs to be adapted. In this embodiment the taking of more than one post-treatment sample at different points of time during chemotherapy is preferred in order to constantly determine whether or not the chemotherapeutic treatment regimen is still successful.

The invention provides for a method of prognosis of a cancer subject that encompasses detection of the tumor cells when the primary tumor has been removed, such as by the methods described above. Thus, the invention provides for determining if the procedures employed to remove the primary tumor were successful and complete. Moreover, the invention provides methods to determine if the tumor has spread. Historically, methods to determine if the tumor had spread relied on pathological and histological methods of determining lymph node involvement and metastasis, such as the cancer staging methods described above. With the present invention, such parameters as tumor load, cancer burden, tumor spread and/or metastasis can be determined by taking a first sample, from which the genomic DNA is evaluated for the presence of a gene or biomarker that is methylated in cancer, but unmethylated in non-cancerous tissue, and taking a second sample, from which the genomic DNA is evaluated for the presence of a gene or biomarker that is methylated in cancer, but unmethylated in non-cancerous tissue, and determining if the tumor or cancer cells remain in the subject and thus further indicate a need for clinical treatment.

In a preferred embodiment, the presence of detectable levels of the biomarker after removal of the primary tumor indicate that the tumor has not been removed completely. More preferably, this situation indicates that the tumor has already spread locally into the surrounding tissue or lymphnodes or systemically into organs other than the colon, rectum or appendix.

In certain embodiments, the detection methods are performed quantitatively, quantitatively in part, qualitatively, qualitatively in part, or quantitatively in part and qualitatively in part.

In certain embodiments the gene or biomarker that is methylated in cancer, but unmethylated in non-cancerous tissue is Septin9. In certain embodiments the gene or biomarker that is methylated in cancer, but unmethylated in non-cancerous tissue is RASSF2A.

Figure 13:
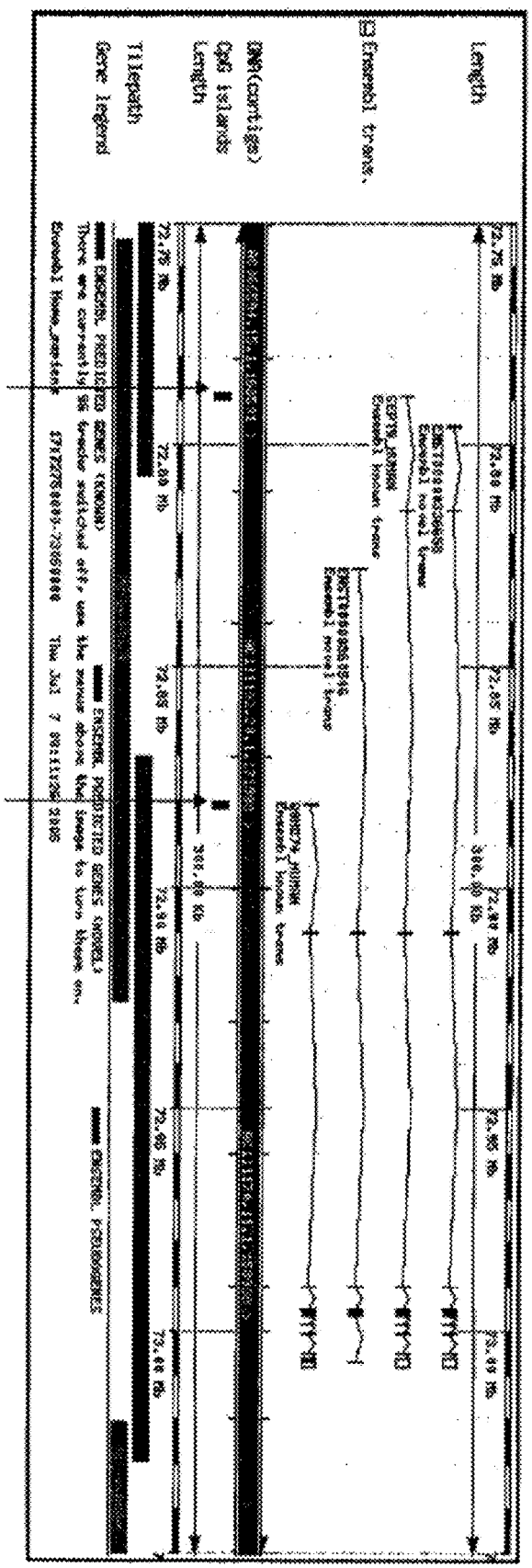
FIG. 13 shows the location of the SEPT9 gene within the human genome on chromosome 17q25 (Ensembl July 2005). Arrows indicating the location of SEQ ID NO: 2 and 3.

The human Septin 9 gene (also known as MLL septin-like fusion protein, MLL septin-like fusion protein MSF-A, Slpa, Eseptin, Msf, septin-like protein Ovarian/Breast septin (Ov/Br septin) and Septin D1) is located on chromosome 17q25 within contig AC068594.15.1.168501 and is a member of the Septin gene family. FIG. 13 provides the Ensembl annotation of the Septin 9 gene, and shows 4 transcript variants, the Septin 9 variants and the Q9HC74 variants (which are truncated versions of the Septin 9 transcripts). SEQ ID NO: 1 provides the sequence of said gene, comprising regions of both the Septin 9 and Q9HC74 transcripts and promoter regions. SEQ ID NO:2 and SEQ ID NO:3 are sub-regions thereof that provide the sequence of CpG rich promoter regions of Septin 9 and Q9HC74 transcripts, respectively. SEQ ID NOs: 4 and 5, are sequences for the chemically (bisulfite)-treated Septin 9 DNA sense strand and the anti-sense strand, respectively, that correspond to the sequence of SEQ ID NO:1 (i.e., where CpG dinucleotides are methylated), as shown in Table 1. SEQ ID NOs: 10 and 11, are sequences for the chemically (bisulfite)-treated Septin 9 DNA sense strand and the anti-sense strand, respectively, that correspond to the sequence of SEQ ID NO:1 (i.e., where CpG dinucleotides are unmethylated), as shown in Table 1. SEQ ID NOs: 6, and 7 are sequences for the chemically (bisulfite)-treated Septin 9 DNA sense strand and anti-sense strand, respectively, that correspond to SEQ ID NO:2 (i.e., where CpG dinucleotides are methylated), as shown in Table 1. SEQ ID NOs: 12, and 13 are sequences for the chemically (bisulfite)-treated Septin 9 DNA sense strand and anti-sense strand, respectively, that correspond to SEQ ID NO:2 (i.e., where CpG dinucleotides are unmethylated) as shown in Table 1. SEQ ID NOs: 8 and 9, are sequences for the chemically (bisulfite)-treated Q9HC74 DNA sense strand and the anti-sense strand, respectively, that correspond to the sequence of SEQ ID NO:3 (i.e., where CpG dinucleotides are methylated), as shown in Table 1. SEQ ID NOs: 14 and 15, are sequences for the chemically (bisulfite)-treated Septin 9 DNA sense strand and the anti-sense strand, respectively, that correspond to the sequence of SEQ ID NO:3 (i.e., where CpG dinucleotides are unmethylated), as shown in Table 1. Septin9 and these variants have also been described in published US Patent Application No: US-2009-0075260, issued as U.S. Pat. No. 7,951,563; published US Patent Application No:2006-0286576, issued as U.S. Pat. No. 7,749,702; and in published US Patent Application No: US-2011-0039719, all of which are incorporated herein for reference to SEPTIN9 gene description and sequence information. Additional sequences related to the Septin9 gene are described in the examples and description herein.

In certain embodiments the gene or biomarker that is methylated in cancer, but unmethylated in non-cancerous tissue is RASSF2A (SEQ ID NO:16). The RASSF2 gene is located at chromosomal location 20p13, and encodes multiple mRNA transcript isoforms. Members of the Ras protein family are associated with cancer, RASSF2 binds to K-Ras, and expression of RASSF2 is associated with controlled cell growth. Loss of expression results in uninhibited cell proliferation, and accordingly RASSF2 is a tumour suppressor gene (Vos et. al. J. Biol. Chem., Vol. 278, Issue 30, 28045-28051, Jul. 25, 2003). The RASSF2 gene comprises a CpG dense region in the gene promoter, spanning the first 2 non-coding exons. This region has been characterised as being co-methylated, and furthermore, methylation thereof has been associated with the development of gastric and colon carcinomas. Hesson et al. (Oncogene. 2005 Jun. 2; 24(24): 3987-94.) characterised the CpG island as being co-methylated, by means of COBRA analysis and bisulfite sequencing of colon cancer cell lines. Furthermore, they confirmed by MSP analysis that 21/30 (70%) of analysed colon cancer cell lines were methylated within the RASSF2A promoter region. Further research has indicated that RASSF2 methylation may be associated with gastric cancer (Endoh et. al Br J. Cancer. 2005 Dec. 12; 93(12): 1395-9) and nasopharyngeal cancer (Zhang et. al Int J. Cancer. 2007 Jan. 1; 120(1):32-8). SEQ ID NO:16 provides the sequence of RASSF2A. SEQ ID NOs: 17 and 18, are sequences for the chemically (bisulfite)-treated RASSF2A DNA sense strand and the anti-sense strand, respectively, that correspond to SEQ ID NO:16 (i.e., where CpG dinucleotides are methylated) as shown in Table 1. SEQ ID NOs: 19 and 20 are sequences for the chemically (bisulfite)-treated RASSF2A DNA sense strand and anti-sense strand, respectively, that correspond to the sequence of SEQ ID NO:16 (i.e., where CpG dinucleotides are unmethylated) as shown in Table 1. The genomic whole gene sequence of which is shown in SEQ ID NO:16, which has been described in published US Patent Application No: US-2010-0092953, which is incorporated herein for reference for RASSF2A gene description and sequence information.

Using the methods of the invention the presence, determined quantitatively, quantitatively in part, qualitatively, qualitatively in part, or quantitatively in part and qualitatively in part of the gene or biomarker in the post-treatment sample in a Stage I or II subject indicates a poor prognosis or need for more aggressive cancer treatment.

Using the methods of the invention an equivalent or higher level of the gene or biomarker in the post-treatment sample in a Stage III subject indicates the need for continued monitoring using the methods described herein to see if there is a tendency of the level of the gene or biomarker to increase.

The methods of the invention provide not only for detecting a change in the level of the gene or biomarker in the post-treatment sample, but also for continued monitoring or surveillance of response to treatment or efficacy of non-treatment of the subject and can be used to determine if the cancer or tumor is in remission or recurrence.

Bisulfite Modification of DNA is an Art-Recognized Tool Used to Assess CpG Methylation Status.

The most frequently used method for analyzing DNA for the presence of 5-methylcytosine is based upon the reaction of bisulfite with cytosine whereby, upon subsequent alkaline hydrolysis, cytosine is converted to uracil which corresponds to thymine in its base pairing behavior. Significantly, however, 5-methylcytosine remains unmodified under these conditions. Consequently, the original DNA is converted in such a manner that methylcytosine, which originally could not be distinguished from cytosine by its hybridization behavior, can now be detected as the only remaining cytosine using standard, art-recognized molecular biological techniques, for example, by amplification and hybridization, or by sequencing. All of these techniques are based on differential base pairing properties, which can now be fully exploited.

An overview of art-recognized methods for detecting 5-methylcytosine is provided by Rein, T., et al., *Nucleic Acids Res.*, 26:2255, 1998.

The bisulfite technique, barring few exceptions (e.g., Zeschnigk M, et al., *Eur J Hum Genet.* 5:94-98, 1997), is currently only used in research. In general, short, specific fragments of a known gene are amplified subsequent to a bisulfite treatment, and either completely sequenced (Olek & Walter, *Nat Genet.* 1997 17:275-6, 1997), subjected to one or more primer extension reactions (Gonzalgo & Jones, *Nucleic Acids Res.*, 25:2529-31, 1997; WO 95/00669; U.S. Pat. No. 6,251,594) to analyse individual cytosine positions, or treated by enzymatic digestion (Xiong & Laird, *Nucleic Acids Res.*, 25:2532-4, 1997). Detection by hybridisation has also been described in the art (Olek et al., WO 99/28498). Additionally, use of the bisulfite technique for methylation detection with respect to individual genes has been described (Grigg & Clark, *Bioessays*, 16:431-6, 1994; Zeschnigk M, et al., *Hum Mol Genet.*, 6:387-95, 1997; Feil R, et al., *Nucleic Acids Res.*, 22:695-, 1994; Martin V, et al., *Gene*, 157:261-4, 1995; WO 9746705 and WO 9515373).

The present invention provides for the use of the bisulfite technique, in combination with one or more methylation assays, for determination of the methylation status of CpG dinucleotide sequences within the genomic sequences. Genomic CpG dinucleotides can be methylated or unmethylated (alternatively known as up- and down-methylated respectively). However the methods of the present invention are suitable for the analysis of biological samples of a heterogeneous nature e.g. a low concentration of tumor cells within a background of blood or ejaculate. Accordingly, when analyzing the methylation status of a CpG position within such a sample the person skilled in the art may use a quantitative assay for determining the level (e.g. percent, fraction, ratio, proportion or degree) of methylation at a particular CpG position as opposed to a methylation state. Accordingly the term methylation status or methylation state should also be taken to mean a value reflecting the degree of methylation at a CpG position. Unless specifically stated the terms "hypermethylated" or "upmethylated" shall be taken to mean a methylation level above that of a specified cut-off point, wherein said cut-off may be a value representing the average or median methylation level for a given population, or is preferably an optimized cut-off level. The "cut-off" is also referred herein as a "threshold". In the context of the present invention the terms "methylated", "hypermethylated" or "upmethylated" shall be taken to include a methylation level above the cut-off be zero (0) % (or equivalents thereof) methylation for all CpG positions within and associated with (e.g. in promoter or regulatory regions) at least one gene or genomic sequence that is methylated in cancer, but unmethylated in non-cancerous tissue.

According to the present invention, determination of the methylation status of CpG dinucleotide sequences within the genomic sequences have utility in the determination of the prognosis of a subject having cancer.

Methylation Assay Procedures.

Various methylation assay procedures are known in the art, and can be used in conjunction with the present invention. These assays allow for determination of the methylation state of one or a plurality of CpG dinucleotides (e.g., CpG islands) within a DNA sequence. Such assays involve, among other techniques, DNA sequencing of bisulfite-treated DNA, PCR (for sequence-specific amplification), Southern blot analysis, and use of methylation-sensitive restriction enzymes.

For example, genomic sequencing has been simplified for analysis of DNA methylation patterns and 5-methylcytosine distribution by using bisulfite treatment (Frommer et al., *Proc. Natl. Acad. Sci. USA* 89:1827-1831, 1992). Additionally, restriction enzyme digestion of PCR products amplified from bisulfite-converted DNA is used, e.g., the method described by Sadri & Hornsby (*Nucl. Acids Res.* 24:5058-5059, 1996), or COBRA (Combined Bisulfite Restriction Analysis) (Xiong & Laird, *Nucleic Acids Res.* 25:2532-2534, 1997).

COBRA.

COBRA™ analysis is a quantitative methylation assay useful for determining DNA methylation levels at specific gene loci in small amounts of genomic DNA (Xiong & Laird, *Nucleic Acids Res.* 25:2532-2534, 1997). Briefly, restriction enzyme digestion is used to reveal methylation-dependent sequence differences in PCR products of sodium bisulfite-treated DNA. Methylation-dependent sequence differences are first introduced into the genomic DNA by standard bisulfite treatment according to the procedure described by Frommer et al. (*Proc. Natl. Acad. Sci. USA* 89:1827-1831, 1992). PCR amplification of the bisulfite converted DNA is then performed using primers specific for the CpG islands of interest, followed by restriction endonuclease digestion, gel electrophoresis, and detection using specific, labeled hybridization probes. Methylation levels in the original DNA sample are represented by the relative amounts of digested and undigested PCR product in a linearly quantitative fashion across a wide spectrum of DNA methylation levels. In addition, this technique can be reliably applied to DNA obtained from microdissected paraffin-embedded tissue samples.

Typical reagents (e.g., as might be found in a typical COBRA™-based kit) for COBRA™ analysis may include, but are not limited to: PCR primers for specific gene (or bisulfite treated DNA sequence or CpG island); restriction enzyme and appropriate buffer; gene-hybridization oligonucleotide; control hybridization oligonucleotide; kinase labeling kit for oligonucleotide probe; and labeled nucleotides. Additionally, bisulfite conversion reagents may include: DNA denaturation buffer; sulfonation buffer; DNA recovery reagents or kits (e.g., precipitation, ultrafiltration, affinity column); desulfonation buffer; and DNA recovery components.

Preferably, assays such as "MethyLight™" (a fluorescence-based real-time PCR technique) (Eads et al., *Cancer Res.* 59:2302-2306, 1999), Ms-SNuPE™ (Methylation-sensitive Single Nucleotide Primer Extension) reactions (Gonzalgo & Jones, *Nucleic Acids Res.* 25:2529-2531, 1997), methylation-specific PCR ("MSP"; Herman et al., *Proc. Natl. Acad. Sci. USA* 93:9821-9826, 1996; U.S. Pat. No. 5,786,146), and methylated CpG island amplification ("MCA"; Toyota et al., *Cancer Res.* 59:2307-12, 1999) are used alone or in combination with other of these methods.

The "HeavyMethyl™" assay, technique is a quantitative method for assessing methylation differences based on methylation specific amplification of bisulfite treated DNA. Methylation specific blocking probes (also referred to herein as blockers) covering CpG positions between, or covered by the amplification primers enable methylation-specific selective amplification of a nucleic acid sample.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers. The HeavyMethyl™ assay may also be used in combination with methylation specific amplification primers.

Typical reagents (e.g., as might be found in a typical MethyLight™-based kit) for HeavyMethyl™ analysis may include, but are not limited to: PCR primers for specific genes (or bisulfite treated DNA sequence or CpG island); blocking oligonucleotides; optimized PCR buffers and deoxynucleotides; and Taq polymerase.

MSP.

MSP (methylation-specific PCR) allows for assessing the methylation status of virtually any group of CpG sites within a CpG island, independent of the use of methylation-sensitive restriction enzymes (Herman et al. *Proc. Natl. Acad. Sci. USA* 93:9821-9826, 1996; U.S. Pat. No. 5,786,146). Briefly, DNA is modified by sodium bisulfite converting all unmethylated, but not methylated cytosines to uracil, and subsequently amplified with primers specific for methylated versus unmethylated DNA. MSP requires only small quantities of DNA, is sensitive to 0.1% methylated alleles of a given CpG island locus, and can be performed on DNA extracted from paraffin-embedded samples. Typical reagents (e.g., as might be found in a typical MSP-based kit) for MSP analysis may include, but are not limited to: methylated and unmethylated PCR primers for specific gene (or bisulfite treated DNA sequence or CpG island), optimized PCR buffers and deoxynucleotides, and specific probes.

MethyLight™.

The MethyLight™ assay is a high-throughput quantitative methylation assay that utilizes fluorescence-based real-time PCR (TaqMan™) technology that requires no further manipulations after the PCR step (Eads et al., *Cancer Res.* 59:2302-2306, 1999). Briefly, the MethyLight™ process begins with a mixed sample of genomic DNA that is converted, in a sodium bisulfite reaction, to a mixed pool of methylation-dependent sequence differences according to standard procedures (the bisulfite process converts unmethylated cytosine residues to uracil). Fluorescence-based PCR is then performed in a "biased" (with PCR primers that overlap known CpG dinucleotides) reaction. Sequence discrimination can occur both at the level of the amplification process and at the level of the fluorescence detection process.

The MethyLight™ assay may be used as a quantitative test for methylation patterns in the genomic DNA sample, wherein sequence discrimination occurs at the level of probe hybridization. In this quantitative version, the PCR reaction provides for a methylation specific amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the HeavyMethyl™ and MSP techniques), or with oligonucleotides covering potential methylation sites.

The MethyLight™ process can by used with any suitable probes e.g. "TaqMan®", Lightcycler® etc. . . . For example, double-stranded genomic DNA is treated with sodium bisulfite and subjected to one of two sets of PCR reactions using TaqMan® probes; e.g., with MSP primers and/or HeavyMethyl blocker oligonucleotides and TaqMan® probe. The TaqMan® probe is dual-labeled with fluorescent "reporter" and "quencher" molecules, and is designed to be specific for a relatively high GC content region so that it melts out at about 10° C. higher temperature in the PCR cycle than the forward or reverse primers. This allows the TaqMan® probe to remain fully hybridized during the PCR annealing/extension step. As the Taq polymerase enzymatically synthesizes a new strand during PCR, it will eventually reach the annealed TaqMan® probe. The Taq polymerase 5' to 3' endonuclease activity will then displace the TaqMan® probe by digesting it to release the fluorescent reporter molecule for quantitative detection of its now unquenched signal using a real-time fluorescent detection system.

Typical reagents (e.g., as might be found in a typical MethyLight™ based kit) for MethyLight™ analysis may include, but are not limited to: PCR primers for specific gene (or bisulfite treated DNA sequence or CpG island); TaqMan® or Lightcycler® probes; optimized PCR buffers and deoxynucleotides; and Taq polymerase.

The QM™ (quantitative methylation) assay is an alternative quantitative test for methylation patterns in genomic DNA samples, wherein sequence discrimination occurs at the level of probe hybridization. In this quantitative version, the PCR reaction provides for unbiased amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the HeavyMethyl™ and MSP techniques), or with oligonucleotides covering potential methylation sites.

The QM™ process can by used with any suitable probes e.g. "TaqMan®", Lightcycler® etc. . . . in the amplification process. For example, double-stranded genomic DNA is treated with sodium bisulfite and subjected to unbiased primers and the TaqMan® probe. The TaqMan® probe is dual-labeled with fluorescent "reporter" and "quencher" molecules, and is designed to be specific for a relatively high GC content region so that it melts out at about 10° C. higher temperature in the PCR cycle than the forward or reverse primers. This allows the TaqMan® probe to remain fully hybridized during the PCR annealing/extension step. As the Taq polymerase enzymatically synthesizes a new strand during PCR, it will eventually reach the annealed TaqMan® probe. The Taq polymerase 5' to 3' endonuclease activity will then displace the TaqMan® probe by digesting it to release the fluorescent reporter molecule for quantitative detection of its now unquenched signal using a real-time fluorescent detection system.

Typical reagents (e.g., as might be found in a typical QM™-based kit) for QM™ analysis may include, but are not limited to: PCR primers for specific gene (or bisulfite treated DNA sequence or CpG island); TaqMan® or Lightcycler® probes; optimized PCR buffers and deoxynucleotides; and Taq polymerase.

Ms-SNuPE.

The Ms-SNuPE™ technique is a quantitative method for assessing methylation differences at specific CpG sites based on bisulfite treatment of DNA, followed by single-nucleotide primer extension (Gonzalgo & Jones, *Nucleic Acids Res.* 25:2529-2531, 1997). Briefly, genomic DNA is reacted with sodium bisulfite to convert unmethylated cytosine to uracil while leaving 5-methylcytosine unchanged. Amplification of the desired target sequence is then performed using PCR primers specific for bisulfite-converted DNA, and the resulting product is isolated and used as a template for methylation analysis at the CpG site(s) of interest. Small amounts of DNA can be analyzed (e.g., microdissected pathology sections), and it avoids utilization of restriction enzymes for determining the methylation status at CpG sites.

Typical reagents (e.g., as might be found in a typical Ms-SNuPE™-based kit) for Ms-SNuPE™ analysis may include, but are not limited to: PCR primers for specific gene (or bisulfite treated DNA sequence or CpG island); optimized PCR buffers and deoxynucleotides; gel extraction kit; positive control primers; Ms-SNuPE™ primers for specific gene; reaction buffer (for the Ms-SNuPE reaction); and labelled nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

Novel utility for the detection of a biomarker that is methylated in cancer, but unmethylated in non-cancerous tissue as a prognostic indicator of cancer/tumor in blood.

In one aspect the method of the invention comprises the following steps: i) determining the methylation and/or expression of at least one gene or genomic sequence that is methylated in cancer tissue, but un-methylated in non-cancer tissue; and ii) determining the prognosis of a subject having cancer. In one embodiment, the steps are carried out in bodily tissue or blood. In an embodiment, the gene is SEPTIN9 (SEQ ID NOs:1-15, and other sequences as described herein), the genomic sequence of which is unmethylated in non-cancerous tissue, and methylated in cancerous tissue. In another embodiment, the gene is RASSF2A (SEQ ID NOs:16-20, and other sequences as described herein), the genomic sequence of which is unmethylated in non-cancerous tissue, and methylated in cancerous tissue.

The method of the invention may be enabled by means of any analysis of the expression of an RNA transcribed therefrom or polypeptide or protein translated from said RNA, preferably by means of mRNA expression analysis or polypeptide expression analysis. However, in the most preferred embodiment of the invention the determination of the prognosis of a subject having cancer, is enabled by means of analysis of the methylation status of at least one gene or genomic sequence, and/or promoter or regulatory elements of the genomic sequence that is unmethylated in non-cancerous tissue, and methylated in cancerous tissue. In other embodiments, the present invention also provides prognostic assays and methods, both quantitative and qualitative for detecting the expression of one or more of the genes in a subject and determining therefrom the prognosis of a subject having cancer in said subject. In other embodiments, hyper-methylation and/or under-expression of one or more of the genes is associated with the progression and aggressiveness of cancer.

In a preferred embodiment the presence of methylated Septin9 DNA in a sample prior to surgery above 3 pg/ml is indicative of the presence of cancer. Preferably, after surgery a negative Septin9 methylation signal is indicative of good prognosis (0 pg/ml methylated Septin9). Preferably after surgery the presence of methylated Septin9 of above 0 to 3 pg/ml sample indicates a low risk for the recurrence of cancer. Preferably after surgery a methylated Septin9 level from 3 to 30 pg/ml plasma is indicative of a medium risk for the recurrence of cancer. Preferably, after surgery the presence of methylated Septin9 of above 30 pg/ml sample indicates a high risk or recurrence. In a preferred embodiment the presence of methylated RASSF2A DNA in a sample prior to surgery above 3 pg/ml is indicative of the presence of cancer. Preferably, after surgery a negative RASSF2A methylation signal is indicative of good prognosis (0 pg/ml methylated RASSF2A). Preferably after surgery the presence of methylated RASSF2A of above 0 to 3 pg/ml sample indicates a low risk for the recurrence of cancer. Preferably after surgery a methylated RASSF2A level from 3 to 30 pg/ml plasma is indicative of a medium risk for the recurrence of cancer. Preferably, after surgery the presence of methylated RASSF2A of above 30 pg/ml sample indicates a high risk or recurrence. Preferred samples are blood, tumor tissue and plasma. Preferably, the cancer is colorectal cancer.

To detect the presence of mRNA encoding a gene or genomic sequence, a sample is obtained from the subject. The sample may be any suitable sample comprising cellular matter of the tumor. Suitable sample types include tissue, blood, plasma, or serum and all possible combinations thereof. It is preferred that said sample types are blood. The sample may be treated to extract the RNA contained therein. The resulting nucleic acid from the sample is then analysed. Many techniques are known in the state of the art for determining absolute and relative levels of gene expression, commonly used techniques suitable for use in the present invention include in situ hybridisation (e.g. FISH), Northern analysis, RNase protection assays (RPA), microarrays and PCR-based techniques, such as quantitative PCR and differential display PCR or any other nucleic acid detection method. Reverse transcription/polymerisation chain reaction technique (RT-PCR) can be used. The method of RT-PCR is well known in the art (for example, see Watson and Fleming, supra).

The RT-PCR method can be performed as follows. Total cellular RNA is isolated by, for example, the standard guanidium isothiocyanate method and the total RNA is reverse transcribed. The reverse transcription method involves synthesis of DNA on a template of RNA using a reverse transcriptase enzyme and a 3' end oligonucleotide dT primer and/or random hexamer primers. The cDNA thus produced is then amplified by means of PCR. (Belyaysky et al, Nucl Acid Res 17:2919-2932, 1989; Krug and Berger, Methods in Enzymology, Academic Press, N.Y., Vol. 152, pp. 316-325, 1987 which are incorporated by reference). Further preferred is the "Real-time" variant of RT-PCR, wherein the PCR product is detected by means of hybridisation probes (e.g. TaqMan, LightCycler, Molecular Beacons & Scorpion) or SYBR green. The detected signal from the probes or SYBR green is then quantitated either by reference to a standard curve or by comparing the Ct values to that of a calibration standard. Analysis of housekeeping genes is often used to normalize the results.

In Northern blot analysis total or poly(A)+ mRNA is run on a denaturing agarose gel and detected by hybridisation to a labelled probe in the dried gel itself or on a membrane. The resulting signal is proportional to the amount of target RNA in the RNA population.

Comparing the signals from two or more cell populations or tissues reveals relative differences in gene expression levels. Absolute quantitation can be performed by comparing the signal to a standard curve generated using known amounts of an in vitro transcript corresponding to the target RNA. Analysis of housekeeping genes, genes whose expression levels are expected to remain relatively constant regardless of conditions, is often used to normalize the results, eliminating any apparent differences caused by unequal transfer of RNA to the membrane or unequal loading of RNA on the gel.

The first step in Northern analysis is isolating pure, intact RNA from the cells or tissue of interest. Because Northern blots distinguish RNAs by size, sample integrity influences the degree to which a signal is localized in a single band. Partially degraded RNA samples will result in the signal being smeared or distributed over several bands with an overall loss in sensitivity and possibly an erroneous interpretation of the data. In Northern blot analysis, DNA, RNA and oligonucleotide probes can be used and these probes are preferably labelled (e.g. radioactive labels, mass labels or fluorescent labels). The size of the target RNA, not the probe, will determine the size of the detected band, so methods such as random-primed labelling, which generates probes of variable lengths, are suitable for probe synthesis. The specific activity of the probe will determine the level of sensitivity, so it is preferred that probes with high specific activities, are used.

In an RNase protection assay, the RNA target and an RNA probe of a defined length are hybridised in solution. Following hybridisation, the RNA is digested with RNases specific for single-stranded nucleic acids to remove any unhybridized, single-stranded target RNA and probe. The RNases are inactivated, and the RNA is separated e.g. by denaturing polyacrylamide gel electrophoresis. The amount of intact RNA probe is proportional to the amount of target RNA in the RNA population. RPA can be used for relative and absolute quantitation of gene expression and also for mapping RNA structure, such as intron/exon boundaries and transcription start sites. The RNase protection assay is preferable to Northern blot analysis as it generally has a lower limit of detection.

The antisense RNA probes used in RPA are generated by in vitro transcription of a DNA template with a defined endpoint and are typically in the range of 50-600 nucleotides. The use of RNA probes that include additional sequences not homologous to the target RNA allows the protected fragment to be distinguished from the full-length probe. RNA probes are typically used instead of DNA probes due to the ease of generating single-stranded RNA probes and the reproducibility and reliability of RNA:RNA duplex digestion with RNases (Ausubel et al. 2003), particularly preferred are probes with high specific activities.

Particularly preferred is the use of microarrays. The microarray analysis process can be divided into two main parts. First is the immobilization of known gene sequences onto glass slides or other solid support followed by hybridisation of the fluorescently labelled cDNA (comprising the sequences to be interrogated) to the known genes immobilized on the glass slide (or other solid phase). After hybridisation, arrays are scanned using a fluorescent microarray scanner. Analysing the relative fluorescent intensity of different genes provides a measure of the differences in gene expression.

DNA arrays can be generated by immobilizing presynthesized oligonucleotides onto prepared glass slides or other solid surfaces. In this case, representative gene sequences are manufactured and prepared using standard oligonucleotide synthesis and purification methods. These synthesized gene sequences are complementary to the RNA transcript(s) of at least one gene that is methylated in cancer, but unmethylated in non-cancerous tissue and tend to be shorter sequences in the range of 25-70 nucleotides. Alternatively, immobilized oligos can be chemically synthesized in situ on the surface of the slide. In situ oligonucleotide synthesis involves the consecutive addition of the appropriate nucleotides to the spots on the microarray; spots not receiving a nucleotide are protected during each stage of the process using physical or virtual masks. Preferably said synthesized nucleic acids are locked nucleic acids.

In expression profiling microarray experiments, the RNA templates used are representative of the transcription profile of the cells or tissues under study. RNA is first isolated from the cell populations or tissues to be compared. Each RNA sample is then used as a template to generate fluorescently labelled cDNA via a reverse transcription reaction. Fluorescent labelling of the cDNA can be accomplished by either direct labelling or indirect labelling methods. During direct labelling, fluorescently modified nucleotides (e.g., Cy®3- or Cy®5-dCTP) are incorporated directly into the cDNA during the reverse transcription. Alternatively, indirect labelling can be achieved by incorporating aminoallyl-modified nucleotides during cDNA synthesis and then conjugating an N-hydroxysuccinimide (NHS)-ester dye to the aminoallyl-modified cDNA after the reverse transcription reaction is complete. Alternatively, the probe may be unlabelled, but may be detectable by specific binding with a ligand which is labelled, either directly or indirectly. Suitable labels and methods for labelling ligands (and probes) are known in the art, and include, for example, radioactive labels which may be incorporated by known methods (e.g., nick translation or kinasing). Other suitable labels include but are not limited to biotin, fluorescent groups, chemiluminescent groups (e.g., dioxetanes, particularly triggered dioxetanes), enzymes, antibodies, and the like.

To perform differential gene expression analysis, cDNA generated from different RNA samples are labelled with Cy®3. The resulting labelled cDNA is purified to remove unincorporated nucleotides, free dye and residual RNA. Following purification, the labelled cDNA samples are hybridised to the microarray. The stringency of hybridisation is determined by a number of factors during hybridisation and during the washing procedure, including temperature, ionic strength, length of time and concentration of formamide. These factors are outlined in, for example, Sambrook et al. (Molecular Cloning: A Laboratory Manual, 2nd ed., 1989). The microarray is scanned post-hybridisation using a fluorescent microarray scanner. The fluorescent intensity of each spot indicates the level of expression of the analysed gene; bright spots correspond to strongly expressed genes, while dim spots indicate weak expression.

Once the images are obtained, the raw data must be analysed. First, the background fluorescence must be subtracted from the fluorescence of each spot. The data is then normalized to a control sequence, such as exogenously added nucleic acids (preferably RNA or DNA), or a housekeeping gene panel to account for any non-specific hybridisation, array imperfections or variability in the array set-up, cDNA labelling, hybridisation or washing. Data normalization allows the results of multiple arrays to be compared.

Another aspect of the invention relates to a kit for use in determining the prognosis of a subject having cancer according to the methods of the present invention, said kit comprising: a means for measuring the level of transcription of at least one gene or or genomic sequence gene that is methylated in cancer, but unmethylated in non-cancerous tissue. In a preferred embodiment the means for measuring the level of transcription comprise oligonucleotides or polynucleotides able to hybridise under stringent or moderately stringent conditions to the transcription products of at least one gene or genomic sequence that is methylated in cancer, but unmethylated in non-cancerous tissue. In a most preferred embodiment the level of transcription is determined by techniques selected from the group of Northern Blot analysis, reverse transcriptase PCR, real-time PCR, RNAse protection, and microarray. In another embodiment of the invention the kit further comprises means for obtaining and/or storing a biological sample of the subject. Preferred is a kit, which further comprises a container which is most preferably suitable for containing the means for measuring the level of transcription and the biological sample of the subject, and most preferably further comprises instructions for use and interpretation of the kit results.

In a preferred embodiment the kit comprises (a) a plurality of oligonucleotides or polynucleotides able to hybridise under stringent or moderately stringent conditions to the transcription products of at least one gene or genomic sequence that is methylated in cancer, but unmethylated in non-cancerous tissue (b) a container, preferably suitable for containing the oligonucleotides or polynucleotides and a biological sample of the subject comprising the transcription products wherein the oligonucleotides or polynucleotides can hybridise under stringent or moderately stringent conditions to the transcription products, (c) means to detect the hybridisation of (b); and optionally, (d) instructions for use and interpretation of the kit results.

The kit may also contain other components such as hybridisation buffer (where the oligonucleotides are to be used as a probe) packaged in a separate container. Alternatively, where the oligonucleotides are to be used to amplify a target region, the kit may contain, packaged in separate containers, a polymerase and a reaction buffer optimised for primer extension mediated by the polymerase, such as PCR. Preferably said polymerase is a reverse transcriptase. It is further preferred that said kit further contains an Rnase reagent.

The present invention further provides for methods for the detection of the presence of the polypeptide encoded by said gene sequences in a sample obtained from said subject.

Aberrant levels of polypeptide expression of the polypeptides encoded at least one gene or genomic sequence that is methylated in cancer, but unmethylated in non-cancerous tissue are associated with the prognosis of a subject having cancer.

According to the present invention under-expression of said polypeptides is associated with a negative prognosis of a subject having cancer.

Any method known in the art for detecting polypeptides can be used. Such methods include, but are not limited to mass-spectrometry, immunodiffusion, immunoelectrophoresis, immunochemical methods, binder-ligand assays, immunohistochemical techniques, agglutination and complement assays (e.g., see Basic and Clinical Immunology, Sites and Terr, eds., Appleton & Lange, Norwalk, Conn. pp 217-262, 1991 which is incorporated by reference). Preferred are binder-ligand immunoassay methods including reacting antibodies with an epitope or epitopes and competitively displacing a labelled polypeptide or derivative thereof.

Certain embodiments of the present invention comprise the use of antibodies specific to the polypeptide(s) encoded by at least one gene or genomic sequence that is methylated in cancer, but unmethylated in non-cancerous tissue.

Such antibodies are useful for determining the prognosis of a subject having cancer. In certain embodiments production of monoclonal or polyclonal antibodies can be induced by the use of an epitope encoded by a polypeptide of at least one gene or genomic sequence that is methylated in cancer, but unmethylated in non-cancerous tissue as an antigene. Such antibodies may in turn be used to detect expressed polypeptides. The levels of such polypeptides present may be quantified by conventional methods. Antibody-polypeptide binding may be detected and quantified by a variety of means known in the art, such as labelling with fluorescent or radioactive ligands. The invention further comprises kits for performing the above-mentioned procedures, wherein such kits contain antibodies specific for the investigated polypeptides.

Numerous competitive and non-competitive polypeptide binding immunoassays are well known in the art. Antibodies employed in such assays may be unlabelled, for example as used in agglutination tests, or labelled for use a wide variety of assay methods. Labels that can be used include radionuclides, enzymes, fluorescers, chemiluminescers, enzyme substrates or co-factors, enzyme inhibitors, particles, dyes and the like. Preferred assays include but are not limited to radioimmunoassay (RIA), enzyme immunoassays, e.g., enzyme-linked immunosorbent assay (ELISA), fluorescent immunoassays and the like. Polyclonal or monoclonal antibodies or epitopes thereof can be made for use in immunoassays by any of a number of methods known in the art.

In an alternative embodiment of the method the proteins may be detected by means of western blot analysis. Said analysis is standard in the art, briefly proteins are separated by means of electrophoresis e.g. SDS-PAGE. The separated proteins are then transferred to a suitable membrane (or paper) e.g. nitrocellulose, retaining the spacial separation achieved by electrophoresis. The membrane is then incubated with a blocking agent to bind remaining sticky places on the membrane, commonly used agents include generic protein (e.g. milk protein). An antibody specific to the protein of interest is then added, said antibody being detectably labelled for example by dyes or enzymatic means (e.g. alkaline phosphatase or horseradish peroxidase). The location of the antibody on the membrane is then detected.

In an alternative embodiment of the method the proteins may be detected by means of immunohistochemistry (the use of antibodies to probe specific antigens in a sample). Said analysis is standard in the art, wherein detection of antigens in tissues is known as immunohistochemistry, while detection in cultured cells is generally termed immunocytochemistry. Briefly the primary antibody to be detected by binding to its specific antigen. The antibody-antigen complex is then bound by a secondary enzyme conjugated antibody. In the presence of the necessary substrate and chromogen the bound enzyme is detected according to coloured deposits at the antibody-antigen binding sites. There is a wide range of suitable sample types, antigen-antibody affinity, antibody types, and detection enhancement methods. Thus optimal conditions for immunohistochemical or immunocytochemical detection must be determined by the person skilled in the art for each individual case.

One approach for preparing antibodies to a polypeptide is the selection and preparation of an amino acid sequence of all or part of the polypeptide, chemically synthesising the amino acid sequence and injecting it into an appropriate animal, usually a rabbit or a mouse (Milstein and Kohler Nature 256:495-497, 1975; Gulfre and Milstein, Methods in Enzymology: Immunochemical Techniques 73:1-46, Langone and Banatis eds., Academic Press, 1981 which are incorporated by reference in its entirety). Methods for preparation of the polypeptides or epitopes thereof include, but are not limited to chemical synthesis, recombinant DNA techniques or isolation from biological samples.

In the final step of the method the prognosis of the subject is determined, whereby under-expression (of mRNA or polypeptides) is indicative of the prognosis of a subject having cancer. The term under-expression shall be taken to mean expression at a detected level less than a pre-determined cut off which may be selected from the group consisting of the mean, median or an optimised threshold value. The term over-expression shall be taken to mean expression at a detected level greater than a pre-determined cut off which may be selected from the group consisting of the mean, median or an optimised threshold value.

Another aspect of the invention provides a kit for use in determining the prognosis of a subject having cancer according to the methods of the present invention, comprising: a means for detecting at least one gene or genomic sequence that is methylated in cancer, but unmethylated in non-cancerous tissue polypeptides. The means for detecting the polypeptides comprise preferably antibodies, antibody derivatives, or antibody fragments. The polypeptides are most preferably detected by means of Western Blotting utilizing a labelled antibody. In another embodiment of the invention the kit further comprising means for obtaining a biological sample of the subject. Preferred is a kit, which further comprises a container suitable for containing the means for detecting the polypeptides in the biological sample of the subject, and most preferably further comprises instructions for use and interpretation of the kit results. In a preferred embodiment the kit comprises: (a) a means for detecting at least one gene or genomic sequence that is methylated in cancer, but unmethylated in non-cancerous tissue polypeptides; (b) a container suitable for containing the said means and the biological sample of the subject comprising the polypeptides wherein the means can form complexes with the polypeptides; (c) a means to detect the complexes of (b); and optionally (d) instructions for use and interpretation of the kit results.

The kit may also contain other components such as buffers or solutions suitable for blocking, washing or coating, packaged in a separate container.

Methylation Analysis

Particular embodiments of the present invention provide a novel application of the analysis of methylation levels and/or patterns within at least one gene or genomic sequence that is methylated in cancer, but unmethylated in non-cancerous tissue that enables determination of the prognosis of a subject having cancer.

In one embodiment of the method, the prognosis of a subject having cancer is determined by analysis of the methylation status of one or more CpG dinucleotides of at least one gene or genomic sequence that is methylated in cancer, but unmethylated in non-cancerous tissue.

In one embodiment the invention of said method comprises the following steps: i) contacting genomic DNA (preferably isolated from tissue, blood, plasma, or serum) obtained from the subject with at least one reagent, or series of reagents that distinguishes between methylated and non-methylated CpG dinucleotides within at least one gene or genomic sequence that is methylated in cancer, but unmethylated in non-cancerous tissue (including promoter and regulatory regions thereof) and ii) determining the prognosis of said subject having cancer.

It is preferred that said one or more CpG dinucleotides of at least one gene or genomic sequence that is methylated in cancer, but unmethylated in non-cancerous tissue are comprised within a respective genomic target sequence thereof as provided in the genomic sequences and complements thereof. The present invention further provides a method for ascertaining genetic and/or epigenetic parameters of at least one gene or genomic sequence that is methylated in cancer, but unmethylated in non-cancerous tissue and/or the genomic sequence according to the genomic sequences within a subject by analysing cytosine methylation. Said method comprising contacting a nucleic acid comprising the genomic sequences in a biological sample obtained from said subject with at least one reagent or a series of reagents, wherein said reagent or series of reagents, distinguishes between methylated and non-methylated CpG dinucleotides within the target nucleic acid.

In a preferred embodiment, said method comprises the following steps: In the first step, a sample of the tissue to be analysed is obtained. The source may be any suitable source, such as tissue, blood, plasma, or serum and all possible combinations thereof. It is preferred that said sources of DNA are tissue, blood, plasma, or serum.

The genomic DNA is then isolated from the sample. Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants e.g. by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA.

Wherein the sample DNA is not enclosed in a membrane (e.g. circulating DNA from a blood sample) methods standard in the art for the isolation and/or purification of DNA may be employed. Such methods include the use of a protein degenerating reagent e.g. chaotropic salt e.g. guanidine hydrochloride or urea; or a detergent e.g. sodium dodecyl sulphate (SDS), cyanogen bromide. Alternative methods include but are not limited to ethanol precipitation or propanol precipitation, vacuum concentration amongst others by means of a centrifuge. The person skilled in the art may also make use of devices such as filter devices e.g. ultrafiltration, silica surfaces or membranes, magnetic particles, polystyrol particles, polystyrol surfaces, positively charged surfaces, and positively charged membranes, charged membranes, charged surfaces, charged switch membranes, charged switched surfaces.

Once the nucleic acids have been extracted, the genomic double stranded DNA is used in the analysis, methylation analysis may be carried out by any means known in the art including but not limited to methylation sensitive restriction enzyme analysis and chemical reagent analysis.

Chemical Analysis

In the second step of the method, the genomic DNA sample is treated in such a manner that cytosine bases which are unmethylated at the 5'-position are converted to uracil, thymine, or another base which is dissimilar to cytosine in terms of hybridisation behaviour. This will be understood as 'pre-treatment' or 'treatment' herein.

This is preferably achieved by means of treatment with a bisulfite reagent. The term "bisulfite reagent" refers to a reagent comprising bisulfite, disulfite, hydrogen sulfite or combinations thereof, useful as disclosed herein to distinguish between methylated and unmethylated CpG dinucleotide sequences. Methods of said treatment are known in the art (e.g. PCT/EP2004/011715, which is incorporated by reference in its entirety). It is preferred that the bisulfite treatment is conducted in the presence of denaturing solvents such as but not limited to n-alkylenglycol, particularly diethylene glycol dimethyl ether (DME), or in the presence of dioxane or dioxane derivatives. In a preferred embodiment the denaturing solvents are used in concentrations between 1% and 35% (v/v). It is also preferred that the bisulfite reaction is carried out in the presence of scavengers such as but not limited to chromane derivatives, e.g., 6-hydroxy-2,5,7,8-tetramethylchromane 2-carboxylic acid or trihydroxybenzoe acid and derivates thereof, e.g. Gallic acid (see: PCT/EP2004/011715 which is incorporated by reference in its entirety). The bisulfite conversion is preferably carried out at a reaction temperature between 30° C. and 70° C., whereby the temperature is increased to over 85° C. for short periods of times during the reaction (see: PCT/EP2004/011715 which is incorporated by reference in its entirety). The bisulfite treated DNA is preferably purified priori to the quantification. This may be conducted by any means known in the art, such as but not limited to ultrafiltration, preferably carried out by means of Microcon™ columns (manufactured by Millipore™). The purification is carried out according to a modified manufacturer's protocol (see: PCT/EP2004/011715 which is incorporated by reference in its entirety).

In the third step of the method, fragments of the treated DNA are amplified, using sets of primer oligonucleotides according to the present invention, and an amplification enzyme. The amplification of several DNA segments can be carried out simultaneously in one and the same reaction vessel. Typically, the amplification is carried out using a polymerase chain reaction (PCR). Preferably said amplificates are 100 to 2,000 base pairs in length. The set of primer oligonucleotides includes at least two oligonucleotides whose sequences are each reverse complementary, identical, or hybridise under stringent or highly stringent conditions to an at least 16-base-pair long segment of the base sequences of one of the bisulfite sequences and sequences complementary thereto.

In an alternate embodiment of the method, the methylation status of pre-selected CpG positions within at least one gene or genomic sequence that is methylated in cancer, but unmethylated in non-cancerous tissue and preferably within the nucleic acid sequences according to the genomic sequences, may be detected by use of methylation-specific primer oligonucleotides. This technique (MSP) has been described in U.S. Pat. No. 6,265,171 to Herman. The use of methylation status specific primers for the amplification of bisulfite treated DNA allows the differentiation between methylated and unmethylated nucleic acids. MSP primers pairs contain at least one primer which hybridises to a bisulfite treated CpG dinucleotide. Therefore, the sequence of said primers comprises at least one CpG dinucleotide. MSP primers specific for non-methylated DNA contain a "T" at the position of the C position in the CpG. Preferably, therefore, the base sequence of said primers is required to comprise a sequence having a length of at least 9 nucleotides which hybridises to a treated nucleic acid sequence according to one of the bisulfite sequences and sequences complementary thereto, wherein the base sequence of said oligomers comprises at least one CpG dinucleotide. A further preferred embodiment of the method comprises the use of blocker oligonucleotides (the HeavyMethyl™ assay). The use of such blocker oligonucleotides has been described by Yu et al., *BioTechniques* 23:714-720, 1997. Blocking probe oligonucleotides are hybridised to the bisulfite treated nucleic acid concurrently with the PCR primers. PCR amplification of the nucleic acid is terminated at the 5' position of the blocking probe, such that amplification of a nucleic acid is suppressed where the complementary sequence to the blocking probe is present. The probes may be designed to hybridize to the bisulfite treated nucleic acid in a methylation status specific manner. For example, for detection of methylated nucleic acids within a population of unmethylated nucleic acids, suppression of the amplification of nucleic acids which are unmethylated at the position in question would be carried out by the use of blocking probes comprising a 'CpA' or 'TpA' at the position in question, as opposed to a 'CpG' if the suppression of amplification of methylated nucleic acids is desired.

For PCR methods using blocker oligonucleotides, efficient disruption of polymerase-mediated amplification requires that blocker oligonucleotides not be elongated by the polymerase. Preferably, this is achieved through the use of blockers that are 3'-deoxyoligonucleotides, or oligonucleotides derivitized at the 3' position with other than a "free" hydroxyl group. For example, 3'-O-acetyl oligonucleotides are representative of a preferred class of blocker molecule.

Additionally, polymerase-mediated decomposition of the blocker oligonucleotides should be precluded. Preferably, such preclusion comprises either use of a polymerase lacking 5'-3' exonuclease activity, or use of modified blocker oligonucleotides having, for example, thioate bridges at the 5'-termini thereof that render the blocker molecule nuclease-resistant. Particular applications may not require such 5' modifications of the blocker. For example, if the blocker- and primer-binding sites overlap, thereby precluding binding of the primer (e.g., with excess blocker), degradation of the blocker oligonucleotide will be substantially precluded. This is because the polymerase will not extend the primer toward, and through (in the 5'-3' direction) the blocker—a process that normally results in degradation of the hybridized blocker oligonucleotide.

A particularly preferred blocker/PCR embodiment, for purposes of the present invention and as implemented herein, comprises the use of peptide nucleic acid (PNA) oligomers as blocking oligonucleotides. Such PNA blocker oligomers are ideally suited, because they are neither decomposed nor extended by the polymerase.

Preferably, therefore, the base sequence of said blocking oligonucleotides is required to comprise a sequence having a length of at least 9 nucleotides which hybridises to a treated nucleic acid sequence according to one of the bisulfite sequences and sequences complementary thereto, wherein the base sequence of said oligonucleotides comprises at least one CpG, TpG or CpA dinucleotide. It is particularly preferred that the base sequence of said blocking oligonucleotides is required to comprise a sequence having a length of at least 9 nucleotides which hybridises to a treated nucleic acid sequence according to one of SEQ ID NOs: 5, 6, 9 or 10 and sequences complementary thereto, wherein the base sequence of said oligonucleotides comprises at least one TpG or CpA dinucleotide.

The fragments obtained by means of the amplification can carry a directly or indirectly detectable label. Preferred are labels in the form of fluorescence labels, radionuclides, or detachable molecule fragments having a typical mass which can be detected in a mass spectrometer. Where said labels are mass labels, it is preferred that the labelled amplificates have a single positive or negative net charge, allowing for better delectability in the mass spectrometer. The detection may be carried out and visualized by means of, e.g., matrix assisted laser desorption/ionization mass spectrometry (MALDI) or using electron spray mass spectrometry (ESI).

Matrix Assisted Laser Desorption/Ionization Mass Spectrometry (MALDI-TOF) is a very efficient development for the analysis of biomolecules (Karas & Hillenkamp, *Anal Chem.*, 60:2299-301, 1988). An analyte is embedded in a light-absorbing matrix. The matrix is evaporated by a short laser pulse thus transporting the analyte molecule into the vapor phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones. MALDI-TOF spectrometry is well suited to the analysis of peptides and proteins. The analysis of nucleic acids is somewhat more difficult (Gut & Beck, *Current Innovations and Future Trends,* 1:147-57, 1995). The sensitivity with respect to nucleic acid analysis is approximately 100-times less than for peptides, and decreases disproportionally with increasing fragment size. Moreover, for nucleic acids having a multiply negatively charged backbone, the ionization process via the matrix is considerably less efficient. In MALDI-TOF spectrometry, the selection of the matrix plays an eminently important role. For desorption of peptides, several very efficient matrixes have been found which produce a very fine crystallisation. There are now several responsive matrixes for DNA, however, the difference in sensitivity between peptides and nucleic acids has not been reduced. This difference in sensitivity can be reduced, however, by chemically modifying the DNA in such a manner that it becomes more similar to a peptide. For example, phosphorothioate nucleic acids, in which the usual phosphates of the backbone are substituted with thiophosphates, can be converted into a charge-neutral DNA using simple alkylation chemistry (Gut & Beck, *Nucleic Acids Res.* 23: 1367-73, 1995). The coupling of a charge tag to this modified DNA results in an increase in MALDI-TOF sensitivity to the same level as that found for peptides. A further advantage of charge tagging is the increased stability of the analysis against impurities, which makes the detection of unmodified substrates considerably more difficult.

In the fourth step of the method, the amplificates obtained during the third step of the method are analysed in order to ascertain the methylation status of the CpG dinucleotides prior to the treatment.

In embodiments where the amplificates were obtained by means of MSP amplification, the presence, absence or class of an amplificate is in itself indicative of the methylation state of the CpG positions covered by the primer, according to the base sequences of said primer.

Amplificates obtained by means of both standard and methylation specific PCR may be further analysed by means of based-based methods such as, but not limited to, array technology and probe based technologies as well as by means of techniques such as sequencing and template directed extension.

In one embodiment of the method, the amplificates synthesised in step three are subsequently hybridized to an array or a set of oligonucleotides and/or PNA probes. In this context, the hybridization takes place in the following manner: the set of probes used during the hybridization is preferably composed of at least 2 oligonucleotides or PNA-oligomers; in the process, the amplificates serve as probes which hybridize to oligonucleotides previously bonded to a solid phase; the non-hybridized fragments are subsequently removed; said oligonucleotides contain at least one base sequence having a length of at least 9 nucleotides which is reverse complementary or identical to a segment of the base sequences specified in the present Sequence Listing; and the segment comprises at least one CpG, TpG or CpA dinucleotide. The hybridizing portion of the hybridizing nucleic acids is typically at least 9, 15, 20, 25, 30 or 35 nucleotides in length. However, longer molecules have inventive utility, and are thus within the scope of the present invention.

In a preferred embodiment, said dinucleotide is present in the central third of the oligomer. For example, wherein the oligomer comprises one CpG dinucleotide, said dinucleotide is preferably the fifth to ninth nucleotide from the 5'-end of a 13-mer. One oligonucleotide exists for the analysis of each CpG dinucleotide within a sequence selected from the group consisting the genomic sequences, and the equivalent positions within the bisulfite sequences. Said oligonucleotides may also be present in the form of peptide nucleic acids. The non-hybridised amplificates are then removed. The hybridised amplificates are then detected. In this context, it is preferred that labels attached to the amplificates are identifiable at each position of the solid phase at which an oligonucleotide sequence is located.

In yet a further embodiment of the method, the genomic methylation status of the CpG positions may be ascertained by means of oligonucleotide probes (as detailed above) that are hybridised to the bisulfite treated DNA concurrently with the PCR amplification primers (wherein said primers may either be methylation specific or standard).

A particularly preferred embodiment of this method is the use of fluorescence-based Real Time Quantitative PCR (Heid et al., *Genome Res.* 6:986-994, 1996; also see U.S. Pat. No. 6,331,393) employing a dual-labelled fluorescent oligonucleotide probe (TaqMan™ PCR, using an ABI Prism 7700 Sequence Detection System, Perkin Elmer Applied Biosystems, Foster City, Calif.). The TaqMan™ PCR reaction employs the use of a non-extendible interrogating oligonucleotide, called a TaqMan™ probe, which, in preferred embodiments, is designed to hybridise to a CpG-rich sequence located between the forward and reverse amplification primers. The TaqMan™ probe further comprises a fluorescent "reporter moiety" and a "quencher moiety" covalently bound to linker moieties (e.g., phosphoramidites) attached to the nucleotides of the TaqMan™ oligonucleotide. For analysis of methylation within nucleic acids subsequent to bisulfite treatment, it is required that the probe be methylation specific, as described in U.S. Pat. No. 6,331,393, (hereby incorporated by reference in its entirety) also known as the MethyLight™ assay. Variations on the TaqMan™ detection methodology that are also suitable for use with the described invention include the use of dual-probe technology (LightCycler™) or fluorescent amplification primers (Sunrise™ technology). Both these techniques may be adapted in a manner suitable for use with bisulfite treated DNA, and moreover for methylation analysis within CpG dinucleotides.

In a further preferred embodiment of the method, the fourth step of the method comprises the use of template-directed oligonucleotide extension, such as MS-SNuPE as described by Gonzalgo & Jones, *Nucleic Acids Res.* 25:2529-2531, 1997.

In yet a further embodiment of the method, the fourth step of the method comprises sequencing and subsequent sequence analysis of the amplificate generated in the third step of the method (Sanger F., et al., *Proc Natl Acad Sci USA* 74:5463-5467, 1977).

In the an embodiment of the method the genomic nucleic acids are isolated and treated according to the first three steps of the method outlined above, namely:

a) obtaining, from a subject, a biological sample having subject genomic DNA;

b) extracting or otherwise isolating the genomic DNA;

c) treating the genomic DNA of b), or a fragment thereof, with one or more reagents to convert cytosine bases that are unmethylated in the 5-position thereof to uracil or to another base that is detectably dissimilar to cytosine in terms of hybridization properties; and wherein d) amplifying subsequent to treatment in c) is carried out in a methylation specific manner, namely by use of methylation specific primers or blocking oligonucleotides, and further wherein e) detecting of the amplificates is carried out by means of a real-time detection probe, as described above, and f) determining a prognosis for the subject.

g) Preferably, where the subsequent amplification of d) is carried out by means of methylation specific primers, as described above, said methylation specific primers comprise a sequence having a length of at least 9, at least 6, at least 25, or at least 50 nucleotides which hybridises to a treated nucleic acid sequence according to one of the bisulfate sequences and sequences complementary thereto, wherein the base sequence of said oligomers comprise at least one CpG dinucleotide.

Step e) of the method, namely the detection of the specific amplificates indicative of the methylation status of one or more CpG positions according to the genomic sequences is carried out by means of real-time detection methods as described above.

Methylation Sensitive Restriction Enzyme Analysis

In an alternative embodiment of the invention the above described second step may be carried out by means of methylation sensitive or methylation specific restriction enzyme analysis. Methods are known in the art wherein a methylation sensitive restriction enzyme reagent, or a series of restriction enzyme reagents comprising methylation sensitive restriction enzyme reagents that distinguishes between methylated and non-methylated CpG dinucleotides within a target region are utilized in determining methylation, for example but not limited to DMH.

In a preferred embodiment, the DNA may be cleaved prior to treatment with methylation sensitive restriction enzymes. Such methods are known in the art and may include both physical and enzymatic means. Particularly preferred is the use of one or a plurality of restriction enzymes which are not methylation sensitive, and whose recognition sites are AT rich and do not comprise CG dinucleotides. The use of such enzymes enables the conservation of CpG islands and CpG rich regions in the fragmented DNA. The non-methylation-specific restriction enzymes are preferably selected from the group consisting of MseI, BfaI, Csp6I, Tru1I, Tvu1I, Tru9I, Tvu9I, MaeI and XspI. Particularly preferred is the use of two or three such enzymes. Particularly preferred is the use of a combination of MseI, BfaI and Csp6I.

The fragmented DNA may then be ligated to adaptor oligonucleotides in order to facilitate subsequent enzymatic amplification. The ligation of oligonucleotides to blunt and sticky ended DNA fragments is known in the art, and is carried out by means of dephosphorylation of the ends (e.g. using calf or shrimp alkaline phosphatase) and subsequent ligation using ligase enzymes (e.g. T4 DNA ligase) in the presence of dATPs. The adaptor oligonucleotides are typically at least 18 base pairs in length.

In the third step, the DNA (or fragments thereof) is then digested with one or more methylation sensitive restriction enzymes. The digestion is carried out such that hydrolysis of the DNA at the restriction site is informative of the methylation status of a specific CpG dinucleotide of at least one gene or genomic sequence that is methylated in cancer, but unmethylated in non-cancerous tissue.

Preferably, the methylation-specific restriction enzyme is selected from the group consisting of Bsi E1, Hga I HinPl, Hpy99I, Ava I, Bce AI, Bsa HI, BisI, BstUI, Bshl2361, AccII, BstFNI, McrBC, GlaI, MvnI, HpaII (HapII), HhaI, AciI, SmaI, HinP1I, HpyCH4IV, EagI and mixtures of two or more of the above enzymes. Preferred is a mixture containing the restriction enzymes BstUI, HpaII, HpyCH4IV and HinP1I.

In the fourth step, which is optional but a preferred embodiment, the restriction fragments are amplified. This is preferably carried out using a polymerase chain reaction, and said amplificates may carry suitable detectable labels as discussed above, namely fluorophore labels, radionuclides and mass labels. Particularly preferred is amplification by means of an amplification enzyme and at least two primers comprising, in each case a contiguous sequence at least 16 nucleotides in length that is complementary to, or hybridizes under moderately stringent or stringent conditions to a sequence selected from the group consisting the genomic sequences, and complements thereof. Preferably said contiguous sequence is at least 16, 20 or 25 nucleotides in length. In an alternative embodiment said primers may be complementary to any adaptors linked to the fragments.

In the fifth step the amplificates are detected. The detection may be by any means standard in the art, for example, but not limited to, gel electrophoresis analysis, hybridisation analysis, incorporation of detectable tags within the PCR products, DNA array analysis, MALDI or ESI analysis. Preferably said detection is carried out by hybridisation to at least one nucleic acid or peptide nucleic acid comprising in each case a contiguous sequence at least 16 nucleotides in length that is complementary to, or hybridizes under moderately stringent or stringent conditions to a sequence selected from the group consisting the genomic sequences, and complements thereof. Preferably said contiguous sequence is at least 16, 20 or 25 nucleotides in length.

Subsequent to the determination of the methylation state or level of the genomic nucleic acids the prognosis of a subject having cancer, is deduced based upon the methylation state or level of at least one CpG dinucleotide sequence that is methylated in cancer, but unmethylated in non-cancerous tissue, or an average, or a value reflecting an average methylation state of a plurality of CpG dinucleotide sequences of the genomic sequences wherein methylation is associated with the prognosis of a subject having cancer. Wherein said methylation is determined by quantitative means the cut-off point for determining said presence of methylation is preferably zero (i.e. wherein a sample displays any degree of methylation it is determined as having a methylated status at the analysed CpG position). Nonetheless, it is foreseen that the person skilled in the art may wish to adjust said cut-off value in order to provide an assay of a particularly preferred sensitivity or specificity. Accordingly said cut-off value may be increased (thus increasing the specificity), said cut off value may be within a range selected form the group consisting of 0%-5%, 5%-10%, 10%-15%, 15%-20%, 20%-30% and 30%-50%. Particularly preferred are cut-offs that are at least 0.1%, 1%, 10%, 15%, 25%, and 30%.

As used herein the term "prognosis" shall be taken to mean an indicator of the predicted progression of the disease (including but not limited to aggressiveness and metastatic potential) and/or predicted patient survival time.

In the context of the present invention the term 'aggressiveness' is taken to mean one or more of high likelihood of relapse post surgery; below average or below median patient survival; below average or below median disease free survival; below average or below median relapse-free survival; above average tumor-related complications; fast progression of tumor or metastases.

Unless stated otherwise as used herein the term "survival" shall be taken to include all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g. time of diagnosis or start of treatment) and end point (e.g. death, recurrence or metastasis).

The disclosed invention provides treated nucleic acids, derived from the genomic sequences, wherein the treatment is suitable to convert at least one unmethylated cytosine base of the genomic DNA sequence to uracil or another base that is detectably dissimilar to cytosine in terms of hybridization for use in determining prognosis of a subject having cancer or a tumor. The genomic sequences in question may comprise one, or more consecutive methylated CpG positions. Said treatment of the nuclei acid preferably comprises use of a reagent selected from the group consisting of bisulfite, hydrogen sulfite, disulfite, and combinations thereof. In a preferred embodiment of the invention, the invention provides a non-naturally occurring modified nucleic acid comprising a sequence of at least 16 contiguous nucleotide bases in length of a sequence selected from the group consisting of the bisulfite sequences, in particular from the sequences as defined by SEQ ID NOs: 5, 7, 10 to 13 and 18 to 20. In further preferred embodiments of the invention said nucleic acid is at least 50, 100, 150, 200, 250 or 500 base pairs in length of a segment of the nucleic acid sequence disclosed in the bisulfite sequences. Particularly preferred is a nucleic acid molecule that is identical or complementary to all or a portion of the sequences the bisulfite sequences but not the genomic sequences or other naturally occurring DNA.

It is preferred that said sequence comprises at least one CpG, TpA or CpA dinucleotide and sequences complementary thereto. The sequences of the bisulfite sequences provide non-naturally occurring modified versions of the nucleic acid according to the genomic sequences, wherein the modification of each genomic sequence results in the synthesis of a nucleic acid having a sequence that is unique and distinct from said genomic sequence as follows. For each sense strand genomic DNA, four converted versions are disclosed. A first version wherein "C" is converted to "T," but "CpG" remains "CpG" (i.e., corresponds to case where, for the genomic sequence, all "C" residues of CpG dinucleotide sequences are methylated and are thus not converted); a second version discloses the complement of the disclosed genomic DNA sequence (i.e. antisense strand), wherein "C" is converted to "T," but "CpG" remains "CpG" (i.e., corresponds to case where, for all "C" residues of CpG dinucleotide sequences are methylated and are thus not converted). The 'upmethylated' converted sequences of the genomic sequences correspond to SEQ ID NOs: 4-9 for SEPTIN9 and to SEQ ID NOs: 17 and 18 for RASSF2A. A third chemically converted version of each genomic sequences is provided, wherein "C" is converted to "T" for all "C" residues, including those of "CpG" dinucleotide sequences (i.e., corresponds to case where, for the genomic sequences, all "C" residues of CpG dinucleotide sequences are unmethylated); a final chemically converted version of each sequence, discloses the complement of the disclosed genomic DNA sequence (i.e. antisense strand), wherein "C" is converted to "T" for all "C" residues, including those of "CpG" dinucleotide sequences (i.e., corresponds to case where, for the complement (antisense strand) of each genomic sequence, all "C" residues of CpG dinucleotide sequences are unmethylated). The 'downmethylated' converted sequences of the genomic sequences corresponds to SEQ ID NOs: 10-15 for SEPTIN9 and to SEQ ID NOS: 19 and 20 for RASSF2A.

Significantly, heretofore, the nucleic acid sequences and molecules according the bisulfite sequences were not implicated in or connected with the prognosis of a subject having cancer.

In an alternative embodiment, the invention further provides oligonucleotides or oligomers suitable for use in the methods of the invention for detecting the cytosine methylation state within genomic or treated (chemically modified) DNA. Said oligonucleotide or oligomer nucleic acids provide novel prognostic means. Said oligonucleotide or oligomer comprising a nucleic acid sequence having a length of at least nine (9) nucleotides which is identical to, hybridizes, under moderately stringent or stringent conditions (as defined herein above), to a treated nucleic acid sequence according to the bisulfite sequences and/or sequences complementary thereto, or to a genomic sequence according to the genomic sequences and/or sequences complementary thereto.

Thus, the present invention includes nucleic acid molecules (e.g., oligonucleotides and peptide nucleic acid (PNA) molecules (PNA-oligomers)) that hybridize under moderately stringent and/or stringent hybridization conditions to all or a portion of the sequences or to the complements thereof. Particularly preferred is a nucleic acid molecule that hybridizes under moderately stringent and/or stringent hybridization conditions to all or a portion of the sequences the bisulfite sequences but not the genomic sequences or other human genomic DNA.

The identical or hybridizing portion of the hybridizing nucleic acids is typically at least 9, 16, 20, 25, 30 or 35 nucleotides in length. However, longer molecules have inventive utility, and are thus within the scope of the present invention.

Preferably, the hybridizing portion of the inventive hybridizing nucleic acids is at least 95%, or at least 98%, or 100% identical to the sequence, or to a portion thereof, or to the complements thereof.

Hybridizing nucleic acids of the type described herein can be used, for example, as a primer (e.g., a PCR primer), or a prognostic probe or primer. Preferably, hybridization of the oligonucleotide probe to a nucleic acid sample is performed under stringent conditions and the probe is 100% identical to the target sequence. Nucleic acid duplex or hybrid stability is expressed as the melting temperature or Tm, which is the temperature at which a probe dissociates from a target DNA. This melting temperature is used to define the required stringency conditions.

For target sequences that are related and substantially identical to the corresponding sequence of the genomic sequences (such as allelic variants and SNPs), rather than identical, it is useful to first establish the lowest temperature at which only homologous hybridization occurs with a particular concentration of salt (e.g., SSC or SSPE). Then, assuming that 1% mismatching results in a 1° C. decrease in the Tm, the temperature of the final wash in the hybridization reaction is reduced accordingly (for example, if sequences having >95% identity with the probe are sought, the final wash temperature is decreased by 5° C.). In practice, the change in Tm can be between 0.5° C. and 1.5° C. per 1% mismatch.

Examples of inventive oligonucleotides of length X (in nucleotides), as indicated by polynucleotide positions with reference to the genomic and converted sequences described herein, include those corresponding to sets (sense and antisense sets) of consecutively overlapping oligonucleotides of length X, where the oligonucleotides within each consecutively overlapping set (corresponding to a given X value) are defined as the finite set of Z oligonucleotides from nucleotide positions:

n to (n+(X−1));
where n=1, 2, 3, . . . (Y−(X−1));
where Y equals the length (nucleotides or base pairs) of SEQ ID NOs: 1-20;
where X equals the common length (in nucleotides) of each oligonucleotide in the set (e.g., X=20 for a set of consecutively overlapping 20-mers); and where the number (Z) of consecutively overlapping oligomers of length X for a given SEQ ID NO: of length Y is equal to Y−(X−1).

Preferably, the set is limited to those oligomers that comprise at least one CpG, TpG or CpA dinucleotide.

Examples of inventive 20-mer oligonucleotides include the oligomers described herein (and the antisense set complementary thereto), indicated by polynucleotide positions with reference to SEQ ID NOs: 1 to 20:

1-20, 2-21, 3-22, 4-23, 5-24, etc.

Preferably, the set is limited to those oligomers that comprise at least one CpG, TpG or CpA dinucleotide.

Likewise, examples of inventive 25-mer oligonucleotides include the following set of xxx oligomers (and the antisense set complementary thereto), indicated by polynucleotide positions with reference to SEQ ID NOs: 1 to 20:

1-25, 2-26, 3-27, 4-28, 5-29, etc.

Preferably, the set is limited to those oligomers that comprise at least one CpG, TpG or CpA dinucleotide.

The present invention encompasses, for each of the sequences that is methylated in cancer, but unmethylated in non-cancerous tissue (sense and antisense), multiple consecutively overlapping sets of oligonucleotides or modified oligonucleotides of length X, where, e.g., X=9, 10, 17, 20, 22, 23, 25, 27, 30 or 35 nucleotides.

The oligonucleotides or oligomers according to the present invention constitute effective tools useful to ascertain genetic and epigenetic parameters of the genomic sequence corresponding to the genomic sequences. Sets of such oligonucleotides or modified oligonucleotides are those consecutively overlapping sets of oligomers corresponding to sequence that is methylated in cancer, but unmethylated in non-cancerous tissue (and to the complements thereof). Preferably, said oligomers comprise at least one CpG, TpG or CpA dinucleotide.

Particularly preferred oligonucleotides or oligomers according to the present invention are those in which the cytosine of the CpG dinucleotide (or of the corresponding converted TpG or CpA dinculeotide) sequences is within the middle third of the oligonucleotide; that is, where the oligonucleotide is, for example, 13 bases in length, the CpG, TpG or CpA dinucleotide is positioned within the fifth to ninth nucleotide from the 5'-end.

The oligonucleotides of the invention can also be modified by chemically linking the oligonucleotide to one or more moieties or conjugates to enhance the activity, stability or detection of the oligonucleotide. Such moieties or conjugates include chromophores, fluorophors, lipids such as cholesterol, cholic acid, thioether, aliphatic chains, phospholipids, polyamines, polyethylene glycol (PEG), palmityl moieties, and others as disclosed in, for example, U.S. Pat. Nos. 5,514,758, 5,565,552, 5,567,810, 5,574,142, 5,585,481, 5,587,371, 5,597,696 and 5,958,773. The probes may also exist in the form of a PNA (peptide nucleic acid) which has particularly preferred pairing properties. Thus, the oligonucleotide may include other appended groups such as peptides, and may include hybridization-triggered cleavage agents (Krol et al., BioTechniques 6:958-976, 1988) or intercalating agents (Zon, Pharm. Res. 5:539-549, 1988). To this end, the oligonucleotide may be conjugated to another molecule, e.g., a chromophore, fluorophor, peptide, hybridization-triggered cross-linking agent, transport agent, hybridization-triggered cleavage agent, etc.

The oligonucleotide may also comprise at least one art-recognized modified sugar and/or base moiety, or may comprise a modified backbone or non-natural internucleoside linkage.

The oligonucleotides or oligomers according to particular embodiments of the present invention are typically used in 'sets,' which contain at least one oligomer for analysis of each of the CpG dinucleotides of a genomic sequence selected from the group consisting the genomic sequences and sequences complementary thereto, or to the corresponding CpG, TpG or CpA dinucleotide within a sequence of the treated nucleic acids according to the bisulfate sequences and sequences complementary thereto. However, it is anticipated that for economic or other factors it may be preferable to analyse a limited selection of the CpG dinucleotides within said sequences, and the content of the set of oligonucleotides is altered accordingly.

Therefore, in particular embodiments, the present invention provides a set of at least two (2) (oligonucleotides and/or PNA-oligomers) useful for detecting the cytosine methylation state in treated genomic DNA (the bisulfite sequences), or in genomic DNA (the genomic sequences and sequences complementary thereto). These probes enable determination of the prognosis of a subject having cancer. The set of oligomers may also be used for detecting single nucleotide polymorphisms (SNPs) in treated genomic DNA (the bisulfite sequences), or in genomic DNA (the genomic sequences and sequences complementary thereto).

In preferred embodiments, at least one, and more preferably all members of a set of oligonucleotides is bound to a solid phase.

In further embodiments, the present invention provides a set of at least two (2) oligonucleotides that are used as 'primer' oligonucleotides for amplifying DNA sequences of one of sequence that is methylated in cancer, but unmethylated in non-cancerous tissue and sequences complementary thereto, or segments thereof.

It is anticipated that the oligonucleotides may constitute all or part of an "array" or "DNA chip" (i.e., an arrangement of different oligonucleotides and/or PNA-oligomers bound to a solid phase). Such an array of different oligonucleotide-and/or PNA-oligomer sequences can be characterized, for example, in that it is arranged on the solid phase in the form of a rectangular or hexagonal lattice. The solid-phase surface may be composed of silicon, glass, polystyrene, aluminium, steel, iron, copper, nickel, silver, or gold. Nitrocellulose as well as plastics such as nylon, which can exist in the form of pellets or also as resin matrices, may also be used. An overview of the Prior Art in oligomer array manufacturing can be gathered from a special edition of Nature Genetics (Nature Genetics Supplement, Volume 21, January 1999, and from the literature cited therein). Fluorescently labelled probes are often used for the scanning of immobilized DNA arrays. The simple attachment of Cy3 and Cy5 dyes to the 5'-OH of the specific probe are particularly suitable for fluorescence labels. The detection of the fluorescence of the hybridised probes may be carried out, for example, via a confocal microscope. Cy3 and Cy5 dyes, besides many others, are commercially available.

It is also anticipated that the oligonucleotides, or particular sequences thereof, may constitute all or part of an "virtual array" wherein the oligonucleotides, or particular sequences thereof, are used, for example, as 'specifiers' as part of, or in combination with a diverse population of unique labeled probes to analyze a complex mixture of analytes. Such a method, for example is described in US 2003/0013091 (U.S. Ser. No. 09/898,743, published 16 Jan. 2003). In such methods, enough labels are generated so that each nucleic acid in the complex mixture (i.e., each analyte) can be uniquely bound by a unique label and thus detected (each label is directly counted, resulting in a digital read-out of each molecular species in the mixture).

It is particularly preferred that the oligomers according to the invention are utilised for determining the prognosis of a subject having cancer.

Kits

Moreover, an additional aspect of the present invention is a kit comprising: a means for determining methylation of at least one gene or genomic sequence that is methylated in cancer, but unmethylated in non-cancerous tissue. The means for determining methylation of at least one gene or genomic sequence that is methylated in cancer, but unmethylated in non-cancerous tissue comprise preferably a bisulfite-containing reagent; one or a plurality of oligonucleotides consisting whose sequences in each case are identical, are complementary, or hybridise under stringent or highly stringent conditions to an at least 9, at least 18, at least 25, or at least 50 base long segment of a sequence selected from the bisulfite sequences; and optionally instructions for carrying out and evaluating the described method of methylation analysis. In one embodiment the base sequence of said oligonucleotides comprises at least one CpG, CpA or TpG dinucleotide.

In a further embodiment, said kit may further comprise standard reagents for performing a CpG position-specific methylation analysis, wherein said analysis comprises one or more of the following techniques: MS-SNuPE, MSP, MethyLight™, HeavyMethyl, COBRA, and nucleic acid sequencing. However, a kit along the lines of the present invention can also contain only part of the aforementioned components.

In a preferred embodiment the kit may comprise additional bisulfite conversion reagents selected from the group consisting: DNA denaturation buffer; sulfonation buffer; DNA recovery reagents or kits (e.g., precipitation, ultrafiltration, affinity column); desulfonation buffer; and DNA recovery components.

In a further alternative embodiment, the kit may contain, packaged in separate containers, a polymerase and a reaction buffer optimised for primer extension mediated by the polymerase, such as PCR. In another embodiment of the invention the kit further comprising means for obtaining and/or storing a biological sample of the subject. Preferred is a kit, which further comprises a container suitable for containing the means for determining methylation of at least one gene or genomic sequence that is methylated in cancer, but unmethylated in non-cancerous tissue in the biological sample of the subject, and most preferably further comprises instructions for use and interpretation of the kit results. In a preferred embodiment the kit comprises: (a) a bisulfite reagent; (b) a container suitable for containing the said bisulfite reagent and the biological sample of the subject; (c) at least one set of primer oligonucleotides containing two oligonucleotides whose sequences in each case are identical, are complementary, or hybridise under stringent or highly stringent conditions to an at least 9 or more preferably 18 base long segment of a sequence selected from the bisulfite sequences; and optionally (d) instructions for use and interpretation of the kit results. In an alternative preferred embodiment the kit comprises: (a) a bisulfite reagent; (b) a container suitable for containing the said bisulfite reagent and the biological sample of the subject; (c) at least one oligonucleotides and/or PNA-oligomer having a length of at least 9 or 16 nucleotides which is identical to or hybridises to a pre-treated nucleic acid sequence according to one of the bisulfite sequences and sequences complementary thereto; and optionally (d) instructions for use and interpretation of the kit results.

In an alternative embodiment the kit comprises: (a) a bisulfite reagent; (b) a container suitable for containing the said bisulfite reagent and the biological sample of the subject; (c) at least one set of primer oligonucleotides containing two oligonucleotides whose sequences in each case are identical, are complementary, or hybridise under stringent or highly stringent conditions to an at least 9 or more preferably 18 base long segment of a sequence selected from the bisulfite sequences; (d) at least one oligonucleotides and/or PNA-oligomer having a length of at least 9 or 16 nucleotides which is identical to or hybridises to a pre-treated nucleic acid sequence according to one of the bisulfite sequences and sequences complementary thereto; and optionally (e) instructions for use and interpretation of the kit results.

The kit may also contain other components such as buffers or solutions suitable for blocking, washing or coating, packaged in a separate container.

Another aspect of the invention relates to a kit for use in determining the prognosis of a subject having cancer, said kit comprising: a means for measuring the level of transcription of at least one gene or genomic sequence that is methylated in cancer, but unmethylated in non-cancerous tissue and a means for determining methylation of at least one gene or genomic sequence that is methylated in cancer, but unmethylated in non-cancerous tissue.

Typical reagents (e.g., as might be found in a typical COBRA™-based kit) for COBRA™ analysis may include, but are not limited to: PCR primers for at least one gene or genomic sequence that is methylated in cancer, but unmethylated in non-cancerous tissue restriction enzyme and appropriate buffer; gene-hybridization oligo; control hybridization oligo; kinase labeling kit for oligo probe; and labeled nucleotides. Typical reagents (e.g., as might be found in a typical MethyLight™-based kit) for MethyLight™ analysis may include, but are not limited to: PCR primers for the bisulfite converted sequence of at least one gene or genomic sequence that is methylated in cancer, but unmethylated in non-cancerous tissue bisulfite specific probes (e.g. Taq-Man™ or LightCycler™); optimized PCR buffers and deoxynucleotides; and Taq polymerase.

Typical reagents (e.g., as might be found in a typical Ms-SNuPE™-based kit) for Ms-SNuPE™ analysis may include, but are not limited to: PCR primers for specific gene (or bisulfite treated DNA sequence or CpG island); optimized PCR buffers and deoxynucleotides; gel extraction kit; positive control primers; Ms-SNuPE™ primers for the bisulfite converted sequence of at least one gene or genomic sequence that is methylated in cancer, but unmethylated in non-cancerous tissue reaction buffer (for the Ms-SNuPE reaction); and labelled nucleotides.

Typical reagents (e.g., as might be found in a typical MSP-based kit) for MSP analysis may include, but are not limited to: methylated and unmethylated PCR primers for the bisulfite converted sequence of at least one gene or genomic sequence that is methylated in cancer, but unmethylated in non-cancerous tissue, optimized PCR buffers and deoxynucleotides, and specific probes.

Moreover, an additional aspect of the present invention is an alternative kit comprising a means for determining at least one gene or genomic sequence that is methylated in cancer, but unmethylated in non-cancerous tissue methylation, wherein said means comprise preferably at least one methylation specific restriction enzyme; one or a plurality of primer oligonucleotides (preferably one or a plurality of primer pairs) suitable for the amplification of a sequence comprising at least one CpG dinucleotide of a sequence selected from the genomic sequences; and optionally instructions for carrying out and evaluating the described method of methylation analysis. In one embodiment the base sequence of said oligonucleotides are identical, are complementary, or hybridise under stringent or highly stringent conditions to an at least 18 base long segment of a sequence selected from the genomic sequences.

In a further embodiment said kit may comprise one or a plurality of oligonucleotide probes for the analysis of the digest fragments, preferably said oligonucleotides are identical, are complementary, or hybridise under stringent or highly stringent conditions to an at least 16 base long segment of a sequence selected from the genomic sequences.

In a preferred embodiment the kit may comprise additional reagents selected from the group consisting: buffer (e.g. restriction enzyme, PCR, storage or washing buffers); DNA recovery reagents or kits (e.g., precipitation, ultrafiltration, affinity column) and DNA recovery components.

In a further alternative embodiment, the kit may contain, packaged in separate containers, a polymerase and a reaction buffer optimised for primer extension mediated by the polymerase, such as PCR. In another embodiment of the invention the kit further comprising means for obtaining and/or storing a biological sample of the subject. In a preferred embodiment the kit comprises: (a) a methylation sensitive restriction enzyme reagent; (b) a container suitable for containing the said reagent and the biological sample of the subject; (c) at least one set of oligonucleotides one or a plurality of nucleic acids or peptide nucleic acids which are identical, are complementary, or hybridise under stringent or highly stringent conditions to an at least 9 base long segment of a sequence selected from the genomic sequences; and optionally (d) instructions for use and interpretation of the kit results. In an alternative preferred embodiment the kit comprises: (a) a methylation sensitive restriction enzyme reagent; (b) a container suitable for containing the said reagent and the biological sample of the subject; (c) at least one set of primer oligonucleotides suitable for the amplification of a sequence comprising at least one CpG dinucleotide of a sequence selected from the genomic sequences; and optionally (d) instructions for use and interpretation of the kit results.

In an alternative embodiment the kit comprises: (a) a methylation sensitive restriction enzyme reagent; (b) a container suitable for containing the said reagent and the biological sample of the subject; (c) at least one set of primer oligonucleotides suitable for the amplification of a sequence comprising at least one CpG dinucleotide of a sequence selected from the genomic sequences; (d) at least one set of oligonucleotides one or a plurality of nucleic acids or peptide nucleic acids which are identical, are complementary, or hybridise under stringent or highly stringent conditions to an at least 9 base long segment of a sequence selected from the genomic sequences and optionally (e) instructions for use and interpretation of the kit results.

The kit may also contain other components such as buffers or solutions suitable for blocking, washing or coating, packaged in a separate container.

The invention further relates to a kit for use in determining the prognosis of a subject having cancer, in a subject by means of methylation-sensitive restriction enzyme analysis. Said kit comprises a container and a DNA microarray component. Said DNA microarray component being a surface upon which a plurality of oligonucleotides are immobilized at designated positions and wherein the oligonucleotide comprises at least one CpG methylation site. At least one of said oligonucleotides is specific for at least one gene or genomic sequence selected from the group consisting of the genes and comprises a sequence of at least 15 base pairs in length but no more than 200 bp of a sequence according to one of the genomic sequences. Preferably said sequence is at least 15 base pairs in length but no more than 80 bp of a sequence according to one of the genomic sequences. It is further preferred that said sequence is at least 20 base pairs in length but no more than 30 bp of a sequence according to one of the genomic sequences. Said test kit preferably further comprises a restriction enzyme component comprising one or a plurality of methylation-sensitive restriction enzymes.

In a further embodiment said test kit is further characterized in that it comprises at least one methylation-specific restriction enzyme, and wherein the oligonucleotides comprise a restriction site of said at least one methylation specific restriction enzymes.

The kit may further comprise one or several of the following components, which are known in the art for DNA enrichment: a protein component, said protein binding selectively to methylated DNA; a triplex-forming nucleic acid component, one or a plurality of linkers, optionally in a suitable solution; substances or solutions for performing a ligation e.g. ligases, buffers; substances or solutions for performing a column chromatography; substances or solutions for performing an immunology based enrichment (e.g. immunoprecipitation); substances or solutions for performing a nucleic acid amplification e.g. PCR; a dye or several dyes, if applicable with a coupling reagent, if applicable in a solution; substances or solutions for performing a hybridization; and/or substances or solutions for performing a washing step.

The described invention further provides a composition of matter useful for determining the prognosis of a subject having cancer. Said composition comprising at least one nucleic acid 18 base pairs in length of a segment of the nucleic acid sequence disclosed in the bisulfite sequences, and one or more substances taken from the group comprising: 1-5 mM Magnesium Chloride, 100-500 µM dNTP, 0.5-5 units of taq polymerase, bovine serum albumen, an oligomer in particular an oligonucleotide or peptide nucleic acid (PNA)-oligomer, said oligomer comprising in each case at least one base sequence having a length of at least 9 nucleotides which is complementary to, or hybridizes under moderately stringent or stringent conditions to a pretreated genomic DNA according to one of the the bisulfite sequences and sequences complementary thereto. It is preferred that said composition of matter comprises a buffer solution appropriate for the stabilization of said nucleic acid in an aqueous solution and enabling polymerase based reactions within said solution. Suitable buffers are known in the art and commercially available.

The present invention also relates to the use of a kit or an oligonucleotide as defined above for for determining the prognosis of a cancer subject, determining medical treatment for a cancer subject, determining if a tumor from a cancer subject indicates that the tumor is aggressive or has metastatic potential or indicates a reduced survival time for the subject, detecting an aggressive form of cancer in a subject, selecting a cancer subject for cancer treatment, or determining tumor load or cancer burden in a subject comprising of a cancer subject.

In further preferred embodiments of the invention said at least one nucleic acid is at least 50, 100, 150, 200, 250 or 500 base pairs in length of a segment of the nucleic acid sequence disclosed in the bisulfate sequences.

TABLE 1

Genomic sequences and treated variants thereof according to the invention

| SEQ ID NO: | Ensembl database* location | Ensembl datanbase* genomic location | Associated gene transcript(s)* | Methylated bisulfite converted sequence (sense) | Methylated bisulfite converted sequence (antisense) | Unmethylated bisulfite converted sequence (sense) | Unmethylated bisulfite converted sequence (antisense) |
|---|---|---|---|---|---|---|---|
| 1 | AC068594.15.1. 168501 150580 to 151086 (+) to AC111170.11.1. 158988 137268 to 138151 (+) | 17 72789082 to 73008258 (+) | Septin 9 & Q9HC74 | 4 | 5 | 10 | 11] |
| 2 | AC068594.15.1. 168501 150580 to 151255 (+) | 17 72789082 to 72789757 (+) | Septin 9 | 6 | 7 | 12 | 13 |

TABLE 1-continued

Genomic sequences and treated variants thereof according to the invention

| SEQ ID NO: | Ensembl database* location | Ensembl datanbase* genomic location | Associated gene transcript(s)* | Methylated bisulfite converted sequence (sense) | Methylated bisulfite converted sequence (antisense) | Unmethylated bisulfite converted sequence (sense) | Unmethylated bisulfite converted sequence (antisense) |
|---|---|---|---|---|---|---|---|
| 3 | AC111182.20.1. 171898 127830 to 129168 (+) | 17 72881422 to 72882760 (+) | Q9HC74 | 8 | 9 | 14 | 15 |
| 16 | | | RASSF2A | 17 | 18 | 19 | 20 |

Example 1

Levels of Septin9 and methylated RASSF2A as examples of genes or genomic sequences that are methylated in cancer tissue but unmethylated in non-cancerous tissue were investigated in matched plasma samples from CRC patients pre- and post-surgical resection.

Levels of Septin9 and RASSF2A were determined by the triplex assay method measuring Septin9, methylated RASSF2A, and HB14 genes. Similar assays can be run in singleplex, duplex, triplex, quadriplex, or multiplex format.

Method for measuring methylation or the methylation status of genes and genomic sequences are known in the art. See, for example, U.S. Pat. No. 7,229,759, or European Patent No: EP 1370691, both of which are incorporated herein for reference to these methylation assay and detection methods. The methylation or the methylation status of genes and genomic sequences herein was measured. The plasma DNA was bisulfite converted and the level of methylated DNA at positions on the genomic sequences was detected in a triplex assay.

Invitrogen magnetic racks (DynaMag-15 and DynaMag-2) were used. Wash A was prepared by adding 45 ml Ethanol (Merck, A000920; 99.8%) to the Epi proColonUS Wash A Concentrate. Wash B was prepared by adding 28 ml Ethanol (Merck, A000920; 99.8%) to the Epi proColonUS Wash B Concentrate. To a labeled 15 ml Falcon tube, 3.5 ml of blood plasma was combined with 3.5 ml Lysis-Binding buffer, mixed by vortexing, and incubated at room temperature for 10 min. To this lysis reaction 90 µl Magnetic Beads (Dynabeads MyOne SILANE, freshly suspended by vortexing for 30 seconds) and 2.5 ml Ethanol was added to atotal volume will be ~10 ml. The tube was mix by inverting by hand 5-6 times and incubated with rotating shaker (Rotator) for 45 min at room temperature. The first wash was performed by placing 15 ml tubes into magnetic rack for at least 5 min after whtich the buffer was discarded and the tubes were transferred into a non-magnetic rack. 1500 µl Wash A (as described above Lysis/Binding Buffer+Ethanol f. d. Molekularbiologie) was added and the beads were resuspended by vortexing for 10 sec. The bead suspension was transferred into a labeled 2 ml tube with transfer pipette. 2 ml SafeLock tubes only to ensure safe closure during 80° C. incubation were used for centrifugation. The transfer pipette was placed back into the 15 ml tube for at least 2 min to collect remaining beads. And placed into the 2 ml tube with same transfer pipette. The 2 ml tubes were placed on the magnetic rack for 2 min after which as much wash buffer as possible was pipette off while taking care not to remove beads. The tubes were placed in a centrifuge and spun for 10 sec at 1000 rcf to collect beads at the bottom, the placed on the magnetic rack for 2 min and remove residual Buffer.

Plasma DNA was eluted by adding 100 µl Elution buffer (10 mM Tris pH 8.0) to each tube and the beads were resuspended by vortex 10 sec, making sure that the pellet was been resuspended completely, then incubated at 80° C. for 15 min in a thermal shaker at 1000 rpm. The tubes were pulse spun to remove drops from the lid. And placed on the magnetic rack for 2 min. The complete eluate (circa 100 µl) was transferred into prelabeled 2.0 ml tubes The plasma DNA was bisulfite converted by adding the following reagents to the eluate: 150 µl Bisulfite Solution (ABS, Ammonium bisulfite solution, use unopened tubes only, discard used tubes) and 25 µl Protection Buffer (contains THFA) (5 g Trolox+40 ml THFA). The tubes were closed and vortexed for 10 seconds to mix thoroughly. The tubes were pulse spun to prevent liquid on the lid, then placed into a thermal block or shaker and incubated for 45 min at 80° C. without shaking. The tubes were pulse spun to remove drops from the lid, then the beads were resuspended by vortexing for 10 seconds, making sure that all beads are thoroughly suspended. The following components were added into each bisulfite reaction in order: 1000 µl Wash A and 20 µl Magnetic Beads (Dynabeads MyOne SILANE) to a total volume of 300 ul and mixed carefully by vortexing, after which they were incubated at thermal shaker and shake at 1000 rpm for 45 min at room temperature. The tubes were pulse spun tube to remove drops from the lid and placed on the magnetic rack for 2 min to capture the particles. Then a fresh pipette was used to remove as much liquid as possible without touching the captured particles. The tubes were removed from the magnetic rack for the washing procedure. 800 µl Wash A was added and the beads were rinsed from the wall, then resuspended by vortexing, pulse spun tube to remove drops from the lid, and placed on the magnetic rack for 2 min. Using a fresh pipet as much liquid was removed as possible, without touching the captured particles. The tubes were taken off the magnetic rack for the washing procedure. 800 µl Wash B was added, and the beads were rinsed from the wall, resuspended by vortexing and pulse spun tube to remove drops from the lid, after which they were placed on the magnetic rack for 2 min. Using a fresh pipet as much liquid was removed as possible, without touching the captured particles. The tubes were taken off the magnetic rack for the washing procedure. 400 µl Wash B was added and the beads were rinsed from the wall, resuspended by vortexing, pulse spun to remove drops from the lid and placed on the magnetic rack for 2 min. Using a fresh pipet as much liquid was removed as possible, without touching the captured particles. The tubes were briefly spun to collect remaining drops to the bottom, placed on the magnetic rack for 2 min then the residual liquid was removed with a pipette. The pellet was allowed to dry for 10 min at room temperature with open tubes on the magnet.

The tubes were transferred into a non-magnetic rack and 55 μl Elution buffer (10 mM Tris pH 8.0) to was added to each tube. The beads were then resuspended by vortex 20 sec.min., after which the tubes were incubated at 80° C. for 5 min in a thermal shaker at 1000 rpm, then vortexed again for 10 sec., briefly spun down to collect all liquid down to the bottom. The tubes were placed on the magnetic rack for 2 min. and the complete eluate was transferred into a 96 well PCR plate (or prelabeled 0.5 ml tubes).

Sequences of probes and primers for triplex assay performed are shown in Table 2

TABLE 2

| Oligo Name | Gene | Function | Sequence | SEQ ID NO: |
|---|---|---|---|---|
| 10307-92 | RASSF2A | Primer | ctaaaacctcaacctaac | 21 |
| 10307-94 | RASSF2A | Primer | gatttagagttgaatgtaaagtaa | 22 |
| 10307-9B1 | RASSF2A | Blocker | cctaacatcttctctcaccccaaacaaaaca | 23 |
| 10307-9taq2 | RASSF2A | Probe | taccgtaaacgaccccga | 24 |
| 17378-109 | Septin 9 | Primer | gttgtttattagttattatgt | 25 |
| Sept9 R 102 | Septin 9 | Primer | aaataatcccatccaacta | 26 |
| Septin9 blocker | Septin 9 | Blocker | gttattatgttggattttgtggttaatgtgtag | 27 |
| 17378-10taq4-TAM | Septin 9 | Probe | ttaaccgcgaaatccgac | 28 |
| HB14.F.2short | HB 14 | Primer | gtgatggaggaggtttagtaagtt | 29 |
| HB14.R.2short | HB 14 | Primer | ccaataaaacctactcctcccttaa | 30 |
| HB14.taq1-BNM5 | HB 14 | Probe | accaccacccaacacacaataacaaacaca | 31 |

Septin9 genomic sequence:
(SEQ ID NO: 32)
Ctgcccaccagccatcatgtcggaccccgcggtcaacgcgcagctggatg
ggatcattt Septin9 bisulfite converted genomic sequence:
(SEQ ID NO: 33)
Ttgtttattagttattatgtcggatttcgcggttaacgcgtagttggatg
ggattattt RASSF2A genomic sequence:
(SEQ ID NO: 34)
Acttagagctgaatgcaaagtaagcgctcgaaatgcagaagtagccgggg
ccgcccacggcacctgcctcgctcggggcgagagaagacgccaggctgag
gtcccag RASSF2A bisulfite converted genomic sequence:
(SEQ ID NO: 35)
atttagagttgaatgtaaagtaagcgttcgaaatgtagaagtagtcgggg
tcgtttacggtatttgtttcgttcggggcgagagaagacgttaggttgag
gttttag

TABLE 3

| CRC Stage | Number of Patients | SEPTIN9 positive BEFORE surgery | SEPTIN9 positive AFTER surgery | RASSF2A positive BEFORE surgery | RASSF2A positive AFTER surgery |
|---|---|---|---|---|---|
| Stage I | 4 | 1/4 | 0/4 | 1/4 | 0/4 |
| Stage II | 9 | 9/9 | 4/9 | 6/9 | 5/9 |
| Stage III | 4 | 4/4 | 2/4 | 4/4 | 2/4 |
| Stage IV | 2 | 2/2 | 2/2 | 2/2 | 2/2 |

Figure 14:
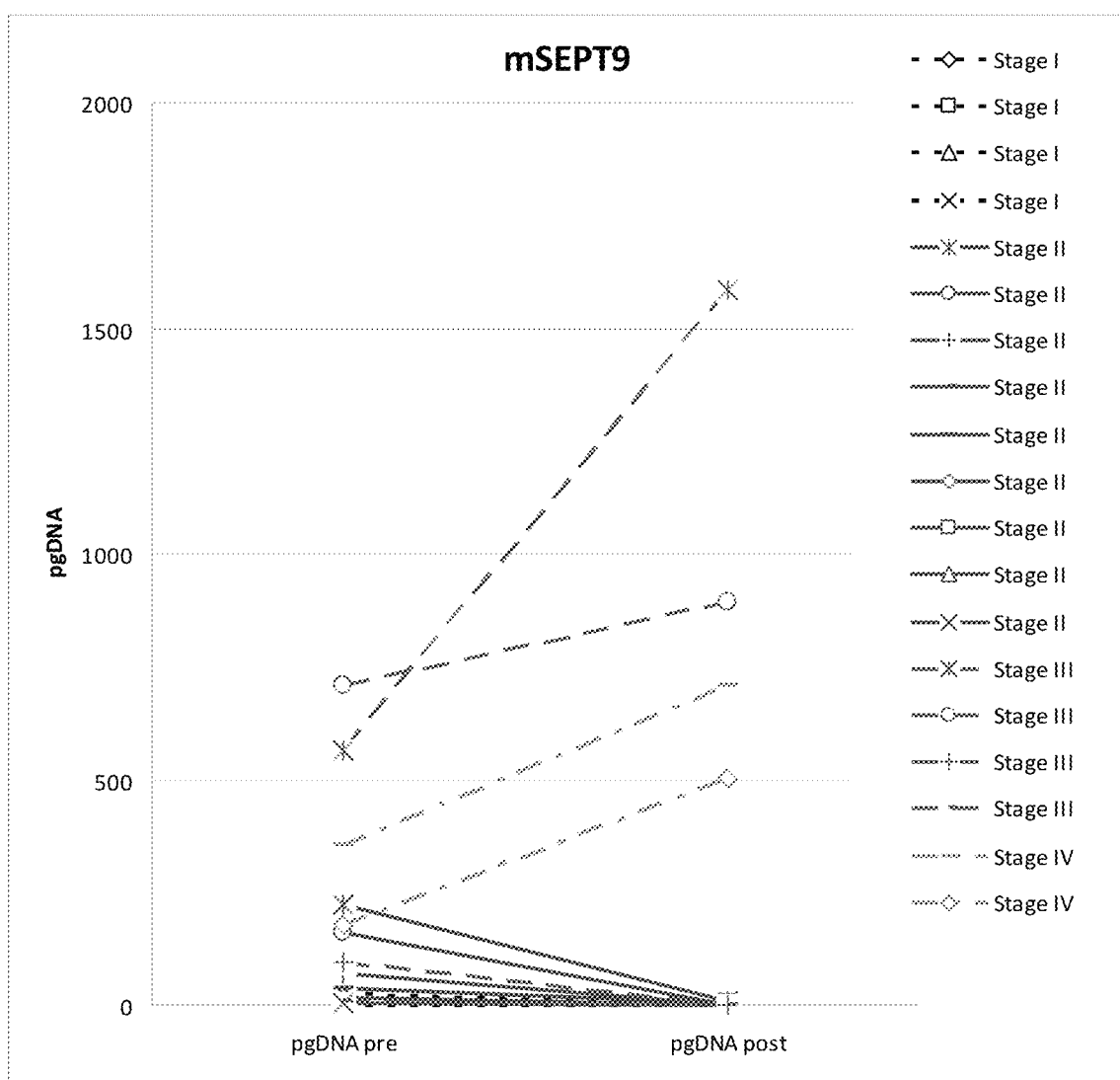
FIG. 14 shows the quantitative Analysis of Septin9 Methylation in Pre- and Post Surgery Plasma from CRC patients.
Figure 15:
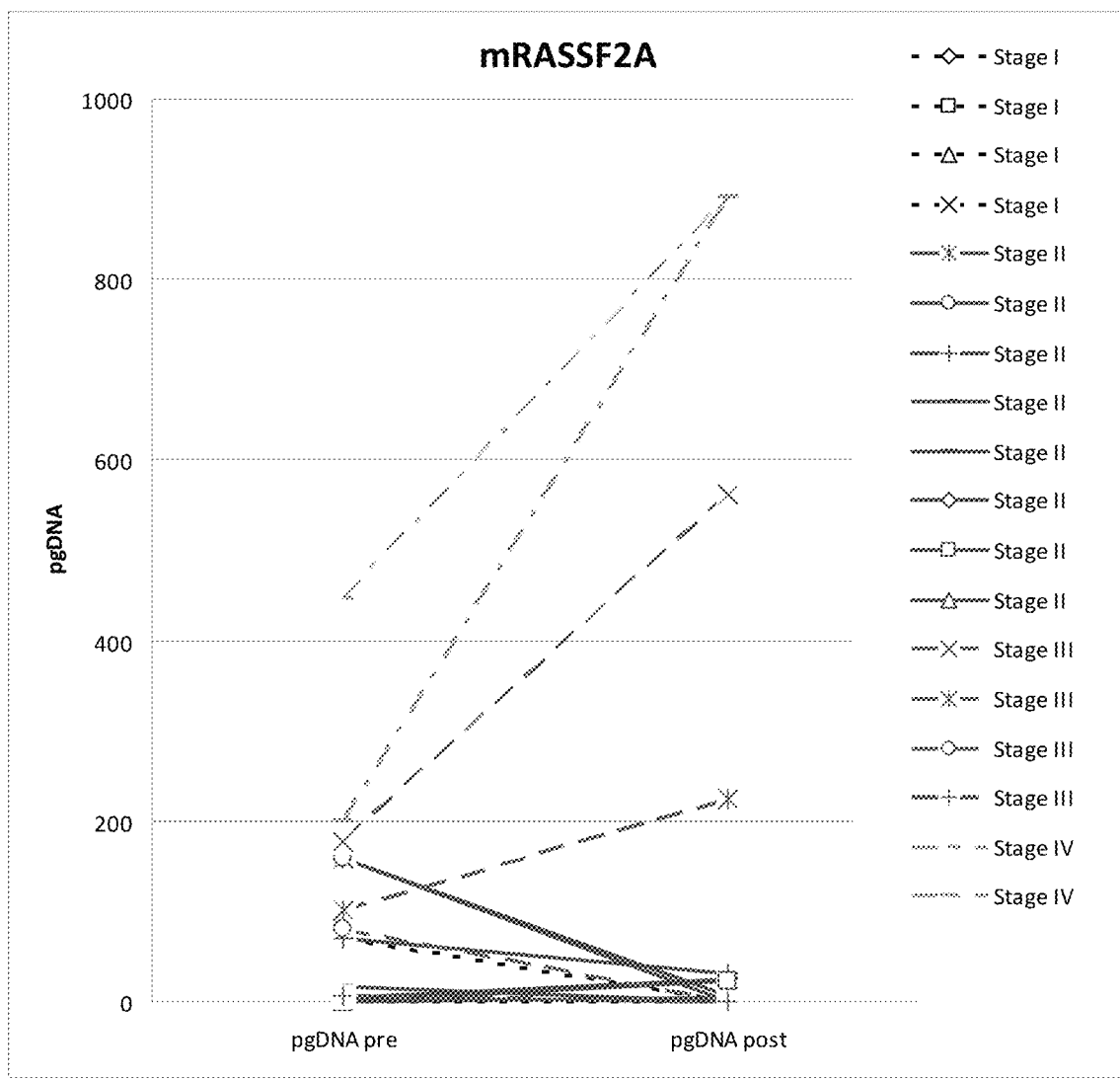
FIG. 15 shows quantitative Analysis of RASSF2A Methylation in Pre- and Post Surgery Plasma from CRC Patients.

The results show that Patients with stage I and II cancers tend to lose Septin9 and RASF2A signal after the surgery, patients with stage III tend to retain the Septin9 and RASF2A signal. The 2 stage IV CRC patients, who already have metastatic disease "retain" the Septin9 and RASF2A signal after surgery. This indicates that the metastasies can be detected by Septin9 and RASF2A even if the primary tumor was resected. The results are depicted in FIGS. 1-12. FIGS. 14 and 15 display the discussed results of Septin9 and RASSF2A in a quantitative matter. The values are indicated in pg methylated Septin9/RASSF2A DNA per ml plasma.

Method for prognosis of CRC patients after curative resection of the primary tumor:

The detection of Septin9 can be done by several state of the art technologies that can detect the DNA methylation in blood/plasma. A qualitative, semiquantitave or/and quantitative analysis of mSeptin9 is possible and is highly connected to the intended use and the patient/tumor population of interest.

Sample Determination of Analysis

For Qualitative Analysis:

Stage I CRC tumor patient.

Before surgery Septin9 signal positive

After surgery Septin9 signal negative=good prognosis

After surgery Septin9 signal positive=bad prognosis (risk of metastasis)

Good prognosis shall mean in preferred embodiments of the invention that the individual who underwent surgery is monitored i.e. one or more tests for the re-occurance of cancer are repeated in time intervals. In a particular preferred embodiment such a test is the detection of methylated Septin 9 DNA as it is disclosed herein, in US 2006-0286576, or WO 2006/113466.

Before surgery RASSF2A signal positive

After surgery RASSF2A signal negative=good prognosis

After surgery RASSF2A signal positive=bad prognosis (risk of metastasis)

Good prognosis shall mean in preferred embodiments of the invention that the individual who underwent surgery is monitored i.e. one or more tests for the re-occurance of cancer are repeated in time intervals.

For Semiquantitaive Analysis:
  Stage I, II and III CRC tumor patients.
Before surgery Septin9 signal positive (1 of 3 replicate measurements)=presence of tumor
After surgery Septin9 signal negative=good prognosis (3 of 3 replicate measurements)
After surgery Septin9 signal 1 of 3 positive=low risk
After surgery Septin9 signal 2 of 3 positive=medium risk
After surgery Septin9 signal 3 of 3 positive=high risk
Stage I, II and III CRC tumor patients.
Before surgery RASSF2A signal positive (1 of 3 replicate measurements)=presence of tumor
After surgery RASSF2A signal negative=good prognosis (3 of 3 replicate measurements)
After surgery RASSF2A signal 1 of 3 positive=low risk
After surgery RASSF2A signal 2 of 3 positive=medium risk
After surgery RASSF2A signal 3 of 3 positive=high risk
For Quantitative Analysis:
  Stage II and III and (IV) CRC tumor patients.
Detection of magnitude of Septin9 before and after surgery e.g. by using an internal standard.
Stage I, II and III CRC tumor patients.
Before surgery Septin9 above 3 pg/ml plasma=presence of tumor
After surgery Septin9 signal negative=good prognosis (0 pg/ml Septin9)
After surgery Septin9>0 to 3 pg/ml plasma=low risk
After surgery Septin9 from 3 to 30 pg/ml plasma=medium risk
After surgery Septin9 above 30 pg/ml plasma=high risk
Detection of magnitude of RASSF2A before and after surgery e.g. by using an internal standard.
Stage I, II and III CRC tumor patients.
Before surgery RASSF2A above 3 pg/ml plasma=presence of tumor
After surgery RASSF2A signal negative=good prognosis (0 pg/ml plasma RASSF2A)
After surgery RASSF2A->0 to 3 pg/ml plasma=low risk
After surgery RASSF2A from 3 to 30 pg/ml plasma=medium risk
After surgery RASSF2A above 30 pg/ml plasma RASSF2A=high risk

SEQUENCE LISTING (35 sequences)

SEQ ID NO: 1 - DNA, 219780 bp, Homo sapiens
  source 1..219909: /mol_type="DNA" /organism="Homo sapiens"
cgttacccgagttgtaaagggcggctccctgtgtctgccccgctgcaccgatacaccgagctgcgcacggtgcccagcgcagggagaacaaatgatcatctgtccaacgcgcccatttacaggtgaggaaactaaggctccaactcaatcgacgcactctgcccttttgattaccagaaaagtagcaggacaggtgtcctgtcccgccctaccccggcccactaagccggcaccccggctccgacccccggctgtgcccggcgccgccgcggtgcccggcgccgccgcctcgcccggcggggccgcccggagcgcccgcacctccgcccgcttccacctggccgggcccgccccgcccggactcgggactgggaagtgcggcgactcccggaaccagccattggcgccagcgcggggagctgggggtgcagagctgcgggcgcggcgggccacgcaggcggcccccacccccggcctggcctggtctggtctggtctgcgctgccgcgcgggggcgccccctcccaggcccggcgcccgccagccccgctccgccaggtgcagcgcagcgcaggggtgggcgggggtggggctcggcgcgcacgttcacggggcggggagggggcgggtcaggggcgggaccacagccggctgggccggggttctatgcgcatctccggggaggggcggggcgggggcggggccggggcggggcccggtcggtgcactccagacggcgggccgccccctcttcccgccttcctactaccggcccaggattagcgccctgggagcgcgcgccccgctgcctcgccgccacactttcctgggagcggcggccacggaggcaccatgaagaagtcttactcaggtgggcttcgcgcccggggtggggaggggtcggtgtcccgggaccagcgctgctcacctgagtgcctgcggccgggagtggcgaggcgcccccggagctgagcgagtccccgcggcgggcacactgcaggtcgagttcctcccaggacagggccgctgtcgggccgctttcgacctgagccgaccgtcccctgcgctgtctccagcccttgctcgagtgtcggaggggctgccctgggggacgctccctcttcctcgccccttgcaccctcgcaggaatcgctgactttccaggtcggccgggtgctttgggtccctgtgcgtctgtgtgggtgaatggggtcggggctaggtggaggggtgtccttgggttcagcctctagggctggtggtccaggccgcagcatcctttcttcggattctcttcggtttctcctctacttagtggggcacgggacggcctccagatgggaccgtccagcagcgcccaaacttggcgactcgggttcacgttttgcgctcaggacgccgcccgcggctgacatcctcactccaccctagcagggcccgccttaagtaggcgaagggggcctgacttgggcctcaccatgagccggttcaggagctttcatttcataagaggctcccgctctggcactctgaagttccatttcacagatgggcacaccgaggccacaagggcaggttaagagaaatccagatcttcattatttgtcttttccttccttttttttttcctttgtggttttctccaaaggatccaggcaggcaggatcctttgtcctcctcagtcctcaaattataaatagcgtctcctcttctaaatctagaaaccgtttgtttaatgtccctcctttaattcattcagatagaaaggtacctgccaaggatccatgaattaatttttattgataggagaacagaatcatgggccttagttggaggtgaaggagtcatcggggccatccccctgcctttgggccattgtcggtttcctctggctttccatatttaggaaccaaaatgagtgataaagtaccttgtctcaaagaggattactcagaacttccccgaaaatacccttctgggtcagtagcttagaatttcaactttcacccggttgttgcgaacaagatggccctctacgcacccggagcacagctctgtcaggagcgtgggtgggttggtgtgctggtgggcgggagcgggcttccaggtggcacatgcttggttttggcaccggggcttcctccccaacatgctccaaatacttgagattgttgtggggatcgcgcggtgcatggccctttccaggggatctctagcccgcccagggagggccctttgcccttggtttcttacactttacctcccactggtgggtccagacagtgggggtgaccggggtcctcccaggtcgtgggtcctgggttttttctgcggagaccctcctgcacagatgccggaagggccctgaggcaggcttggagtctctgcacctgcggcttactgggaggtggggagaccatcacttgtccttttctcctctcctccacacacacctaccccacccctcactgggtttcttttttttttttttttttaaaaaaaaggacagaaccttttgcagtaggtggaagtagagtttgtggagtgagcaggaaccaactcttgtacagcagcctcggtgcctccttgtgtttacctaaaggggcaggcccctctgaggatgggggaagggagggctcagaccatttctggtttgctccctgcttggcagtggcccaaggtgtgctgggtcactgtgttgcagttgtatggagtgggactggagggggctgatggtgggggtggcctcttgccctcattctgagtgtcctggagctgtcttggcaccagcccttttccgggtacgggcactcgcaggagtcaggctgaccccccaacaagccatcgacaccatgaaattaaggaaagcagcaaaagatgttaaaaatcccccaaggctctgacaatccaaggacaacaggaaggtctttattttttcatctagactgtgcgggattattgcttccagacctgtatgtgggcttcagaataaacggaatgaccataatgttgttcccggtagacctggtttgaacattcgtgagcctctgaaaaggagaaagattttagaaggatgtgttggggcaatctcaagtaccgtgggtctatagacagtcatcgaagacactttatgtgctgggcacacatggccaagtctgagtgggtacagaaatggtaatgagatatagtccttgcctgcagagaacttacattctcaccgggagtcaggatgagggcgagacaccagctcattaacacccttccctcctgagcagttcagcctccaaatactacaggaatgccccggaggttttaggtggaggtgagattgagctgggccttgaggaaggagaagtcttgagtagtggagaataaaaagggacttggccaggtgcgcttgaagtcccagctactcaggaggctgagacacgaggatcgcttgagcccaggaggctactcaggaggctgagacacgaggatcgcttgagcccaggaggctactcaggaggctgagacaggaggatcgcttgaagccaggagttcaaggctgcagccctgtgacagcgcctggaaatagacacggcactccagcctgggtggcgtcatgagaccccatctgtaagaaggtcttttccaatgcggaaggcagcaagggcccacacagggcagctgcaggatccagggggacactggggacaggttctctctggcagctccactgctgctccaggctttcccgattgcctcacccggccttccaatggggtggaggtagtggtagtctacaggcagtgtggtccagtggttacacttgggggctcagagccgccagccccttgggattaaatctcaccaggctgcgcctctccctgtggcacaaggttctcacctcatgcatctcatttgcctcatttgtttttttgtgtgtgtggtgttttttaattttatttatttatttatttttgagacggagtctcactctgtctcccaggctggagtgcaatggcatgatctcagcttactgcaacctccgcctcccaggttcaagtgattctcctgcctcagcctcctgagtggctgggattgtaggaacgtgccactgcgcccagctaatttttatatttttactagagatggggtttcaccatgttggtcaggctgatctcgaactcctgacctcgtgatctgcctgccttggcctcccaaagtgctgtgattacaggcatgagccaccacgcccagcctgcctcatttgttaaatgggacagtgctatgttgttgtaaaggttaaacgagttcatatttgaaaaagctgagaaatgcctgctctgtaacctgttagctgctgtcatgatcatgattgtcattgacaggaggatggagaaggctggggttacgccattgctaggacgttccagaagcctccatgatcttcccttactgtggtcagagcatggtgcagggtctctcccccagcccctcagcactggagccagctgcactgtacccgccctggctctctaggttctgagttttgggactccctttgcatactaggtcacatggaacttgccgtcattcccaggctcccctggaaactctctgtgggtggcagcggcaggaggacttacccgaggccgatgagccacagaagcgggactgaggttgcgtcacacccctactggcacctgggaattactctggagattctttttttattttttatttttttgagatggagtcttgctctgttgcccaggctggagtgcagtggcacgatctcggttcactgcaacctctgcctcccaggttcaagcaattctcatgcctcagcctcctgagtagctgggattacaggcatgtgccaccgtgcccagctaatttttgtattttttagtagagatggggttttaccatactggccaggctggtctcgaactccggacctcaggtgatccacccgcctcagcctcccaaagtgctgggatcacaggcatgagccaccgtgcccagccactctggagtttctctgtggctttcaggagattcctgaaggggcaccagccacgattaaaaagctctatgctgtcgtgacttctgagtcctgggcagggagggaggctgcacccacacaggaagcagcttctgccgtgattcagtgtgctggctcgccgtggtggacagggctgcaccctcacccagcgccccgggagctgacttacgggaagggcaaggaattgcaccctcagagaacacttccccagtcagctaacccggtgacaggcgagcgtgggaagggcacaagcacagggtttcttcctcttctcccccagccccgtctccgcgcctgttctcgctgcctcttgcctcctcacgtccaagcttgtctgctctggcgcattcaggggacctggactggagagaaaaagccacctcgtacggttagtctgtggctctgtctgacttgtgtcctccgccgaggcccctcagttgtgagacagctggctgagcctaagtcctggggccagccctctccctagtctgttgcaaaggtagaaaggcatgcccaggcaggggccacctgccctgcccgctcacgccagaccgcaggcacttgcccgtcagatctccccggcctgcccagagggattctgatagccgagggcaatgcacctggcagcggagcattgcgtttgcgacagtccaccttcttcctggaaccaccccccacaagtgtgaccagctcaagccaggacaggtacagggggacccaggattgccacttaggggcagtggtctggaatccaggtccaggtgacatgggagccaaccctctgcttggagatcccaggtgggtgtttgcagaggacatctcacttgaggacccatggaaggggacacttcccaccccctacctggtccttgggctgccctcctctgacactctcctgccatcccaggcagccctgacagccccatgtgactgggacctagaggtggcccctgtttccgccccagtgtttgtccacaggcagtgttgcgtgggctctgaagtttgcctaagatggacctgataaggggagttcagtacacatcagtgcaggcccggccagggggtgatgatggcagttcctgggcagatccagctggctttagggtaggaggggctccagagagaggctccaggcccctaggggtgtgaacctttggggtgaggcgggaagtgacgcgctgggttcctgcgcctctgtttgttggagctattaccttggaaacatcccagctctaggcggttgccagggatttatggggatcagtgggtgccaatccctgggtgaagccctcggggcttgtacacagcacacagcgctgtggccccatggctcactttgctgtgtgaagtggctcagtctccgggagagtccttagccaggcaggcctgacggcaactgccaggtcatggtgatctggaatcgctgaccaaagggagtcagtcctggtgggtggagggacttggtgggcagccatcgtgatgccaggcatggggatcgtgtgtcacccaggcctgtgggtgccgagcttctgtgggagcagtgaagtgcccccgtggccgatgggctggtcacccctgcccctttcctgatgtgacagttgtgcctgggccccgggaaatttgccaggaggcctggcattggcctgctctactggagcggccctgctgagctgtgagctgcccgtctccctgaggttcctagcccatttcaactctccatgtggatttggtcattcattccagaagcgtctgccgggcgctgctgagtgtcaggttctgtttgcctcctctcctgtacgctggaggctctgggcaccagctctgcagggtggcctggccttgggtctccagggtagagcatggcactctctgctcccagcccagtttctctctgctttatctccctgaccccaccctgggcatgggcccatttgcagcccctgtgaagggagacattgagctgttgctggcagaggaggggcggctcctgggcactgcttgccaatggcctctcggcagctctgtgacagctgagctttgttcccagcctaatctgacctggttctccaaagcatgactgttggcagcctgaaaacctccaggacaggaaacaggagtggcgcagggaatgtaagatgatcccagcttcaagtcactgggcggcccttagacccaggctgcctgctgtctctggcaggaactcaagtcgctggtcatcctcagagcggtgttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggtgggtgcattgctctctttccggctcctcccaggctgcttaaatgacctgtgacgaggcctgcgccatggccggggccctctgcttttcccagcgctgcacctgggaaccaggggttgggccccggaagccgaggatgtccctgaatgccatgcctgggcacctgtcctggccaggcgaggcgtgttggggcagcggctgagatgggagcagcagcattgcctgccaggtttgagatgggccccgggtgagtgtggttaccaggaagggctgggcagagcaggcgggtgggccgcccctggggccttgttccgcagatcaacctgatccgcaccctggggccggggcttcctttcacagccttcccatgaactatggctcctgtttccatcccaaatcagatcccagaagaggaataatgtccatgtaacccaagccagttggaagtgggttacatccaacccctgtcatcttccagcttgttaaggacttgactaactcaacccagagggatttggagggttgtctgcaaaacccactaataacagggaactttagctctgtagccacagggtctacagaggtgtcgggctgtcgggttattgctgggaggtgagccggtggcgtagacaccatggaggcaccggtagtggaagagctgcaagtgcacacagaggccggcaccgaggggcggggaggaggaggtggtggatttctcgccagtgttggcatcatgttgcctccagcatcagagacccaaggtgtggctgaccttggctggggcgatgagtcattggatagcagagccttcctggtagctgggggttaacgctttaactgccgggactttgtattatgccgcttcttttttttgttttgtttggtttggtttggtttggtttttgagacggagtctcactctgtcacccaggctggagtgtggtggctcaatcttggctcactgcaacctctgcctcctgggttcaagcaattctcctgcctcagcctcctgaatagctgggattacaggcacgcgccaccatgcctggctaatttttgtatttttagtagagatggggtttcgccatgttggccgggttggtttcaaactcctgacctcaggtgatccacctgccccggcctcccaaagtgctgggattacaggcatgagctaccgcgcccagcttgcatttatgcttttttttttttttttttgagatggagtttcgctcttgttgcccaggctggagtgcaaaggcgcgatctcagctcactgcaacctccacctcccgggttcaagcgattctcttgcctcagcctcccaagtagctgggattacaggcctgcgtcaccatgcccggctaattttgtatttttagtacagacggggtgtccccatgttggtcaggctggtctcgaactcccgacctcaggtgatccgcccgccttggcctcccaaagtgctgggattacaggcgtgagccaccgcacccggcctatgctttttattattattatttaattttttaaggaaagcaatctaaactgtacactgtatcttttctttctcttttgctttttgttgtcagttttctgtattacttattgccaaacaacatgaacaggaaattgaaaggaaaacttcaacaatcattggctgtagcatttcttctgtgttccattcagtgcttgtctcctcaggaacatgacatagggtttgatttaattatgaaaggcgtatattttcagagttttatactccccatagaatgaatgttgaattctgttcttttcacttgaaattagatctcaggcatggatttcatgattatcactataatggctcttcagagtggacattgcatcttgtagggaaccaccctctccccagctgctggtgtggacgctcctccttgatggtgtgggtctgggcccctgaagggtggtgtcctgagtaaagatgttacagtagccatgcttatagctttgggcctggggctaggtggagactggcttcaaccctagagcttgctgtcttaaaataaattcttttttttttttttttgagatggagtctcgctctgttgcccaggctggagtgcagtggcgcgatctccgctcactgcaagctccgcctcccgggttcacaccattctcctgcctcagcatcccgcatagctgggactacaggcacccgcccccacgcccggctaattttttgtatttttttagtagaggcggggtttcaccatgttagccaggatggtctcaatcttctgacctcgtgatccactcgcctcagcctccaaagtgctgggataaaataaattcttagggccgggagcggtggctcacacctgtaatcccagcactttgagaggccgaggcgggcagatcacaaggtcagaagatcgagaccatggtgaaaccccgtctctactaaaaatacaaaaaattagctgggtgcagtggcgggcgcctgtagtcccagctactcgggaggctgaggcaggagaatggcatgaacccggaaggcggagcttgcagtgagccgagattgcgccagtgcactccagcctgggcgacagagtgagaccctgtctcataaataaataaataaataaataaataaataaattcttatacccacttgcattatttattattattattattaaacagggtcttgctgtgttgcccaggttggagtgcagtggcgtgatcatgacctcccagtctcgacctcccagtttcaattggtcctcccttctcagcctcctgagtagctgggactacaggtgtgcgctgcatgcctggctaattttttttttttttttttttttgagacagagtcttactctgttgcccaggctggagtgccgtggtgcaatctcggctcactgcaacccccggctcctggattaaagcaattctcctgcctcagcctcctgaatagctgcgattacaggcatgtgccgccacacctggctaatttttgtatttttagtagggacggggtttcaccatgttggtcaggctggtctcaaactcctgacctcgtgatccacctgccttggcctcccaaagtgctgggattacaggtgggagccaccgcgcctggcatgcctggctaatttttaaaaaatttttgtagcagccgggcgcggtggctcatgcctgtaatcctagcactttgggaggccaaggaggtcgggagttcgagaccagcctgaccaacatggagaaaccctgtctctactaaaactacaaaattagctgggcatggtggcacatgcctgtaatcccagctactcaggaggctgaggcaggagaattgcttgaatctaggaggcgggggttgcagtgagctgagatcgtgccacggcactccagcctgggcaaagagagtgaaactccgtctcaaaaaatttttgtttttgtttttgtagcgacagggtcttgttttgttgttgcctaggctggtactgaatttccagcctcaagcgatcctcctgcctcagcctcccaaagcgctgggagtacaggcgtgagtcactgtgcctggcctccacttgctttggctgcctttctctgtcttaggtaaccatacatttctccaggtaattaagaaaagattgcgcatgatgagtcccttttctggtatttctgggattgcccccaaaaccagacaagtgttcttaccttgacattttattaagactttaatgaacagaatgccgtttgccctcagtctgctggtccccctgcgaaggcccagggcttccttgtttgaaaagtcatccccttgtcgaggtctttgattccttttcaccacggcagtcatgccgagggtccacagagccaccccttccccatctcttcctcggcccctcaagacgcatctgtacccccggagatgtctctttgttttcttgggccacctctcctggccgtcactcaccctgctgactcattacttgtgcaacagtttcttctggaaccctcaggctcctgccacctaccctctgcagtccccgttttgttcctcttgcctcagtcttcctccccatcacccctctacctgttggtctccatctctgtctatggcacatccctgtgttatactctgatggctggataaaggttgagtgaaacgcatctacccctttggtgactggggtgcccattaatcagaagggatccaaggctggcgtagccttttcccgcatcctggggtatcgtcctgtggctcttccttgttggagtctgcagttttttgtttttttttttttaaattttttgagatggagtctcgctctgtcgcccaggctggagtgcagtggtgagatcccagctcactgcaacctccgcctcccgggttcaaccaattctcctgcttcagcctcccaagtagctgggactacaggcgcccgccaccatgcctggccaattttggtatttttagtagagacggggtttccctacattggccgggctggtctcgaactcttgacctcaggtgataggctcgcgtcggcctcccaaagtgctgagattacgggcatgagccaccaggcccggccgttgagattaccttcataagccaccaggcctggctgtagttggcagtttttgaccactggtctcgctccacgtgatctgtgatcttccccttggccccctggccctgccctgttcatctgctcacctttctcatgcatgcggtttgttcatagggtatgtaatggggtctaaccaggaaatggaaaccgcttgagcatttatttatttatttatttatttatttatttatttatttttcccaagacaaggtctcactctgtcacgcaagctgaagtgcagtggtgtgatcacagctcatggcagccttgaactcctgagctcaagcgatcctcccttctcagcctcccaagtagctcggactataggtgcacactatatgcctgcctaattttttcttttatttttgtagagacagggtcttgctttgttgcccaggctggtcctgaactcccaacctcaagcaatcctcctgcctcagcctcccaaagtactggagctacaggcatgtgccatcacgccttgctaatttttgtattttttgtgtgtgtgtaaagacaaggtcttactatgttgcccaggttggtcttgtactcctgggtttatgtgatcctcctgcctgggcctcccaaagtgctgggattacaggcgggagccacagtgcctggtccacttgagcatttagaacagaaggacttaaaggcggggaactagttacacagatgatgggagaggtgaaggccagacagggaacagagaggcaatcagcaggaaatcaaagtggtgtgggcttatacagccctctaaaggtatggatgcaatgattcatttagaatgagaaaataaataacagcaaattataaattataagcagctgttaaatatcacaaacatcactacatgcagaagagtaccagtcaactgtcagtcatatctccaaagttctatttctcccacatttttggcattacttcttcaatatgatgactttgtaatatcgttttctatttcgagaacagaaaactgatcaggctggacacagtggctcgtgcctgtaatcccagcactttgggaggccaaggcaggtggatcacttgaggccaggagttcaagaccggtccgggcagcgtggcgaaaccccgtctctactaaaaatacaaaaactagcagggcatggtggcatacacctgtagtcccagttacttaggaggctgaggtgggaggattgcttgagcccaggaggtcgaggctgcagtgagccgtgatcatgccactgcactccagcctgggtgagagagtgagaccatgtctcaaaaaaaaaaaaaaaacaacaaaaaaaaacataggctgggcgtggtggctcacgcctgtaattccagcactgtgggaggttgagatgggcggatcacttgaggtcaggagtttgaaaccagcctggtcaacatggtgaaaccccatctctaccaaaaacataaaaaattagccaggtgtgatgacgcacgcctgtaatcccagctacttgggaggctgaggcaggagaatggcttgaacccaggaggcagaggttgcagtgggccaagatcgtgccattgcactccagcctgggcaacagagtgagactccatctcaaaaataaataaataaataaagcgaatgaatctccttagttgatcaaattttgtttttatttttggtagttgggatgtatacaaaagtggcggtcaacatggagttggtggtgctgctacaattgttttgttcaagatacacaggaattctggtaaatcctgtttttttctttttttttaaatgtgattcccatcaagaaagaagtaggaaaatgggggagatttctaactgcatatgaggcatttgtgcatgtatttctgaccagagagacttttctgttttgactccacattgaaggaactgaatcctttgcttacaacttcacctctggtgatgggagtaattttccacagatttgcttctggacccgtgcatttcaaatcttgcttctctccactgcgcacgtttttccggcgccaggcaccgcaggatatgttcgtgtcttgtgatttttgattctgcgcggtaggtggaattggaacggtgagtggagcgagtattgctggaatccgtttccacaccgggatagcgagcagtaactgaactatacatggaaataaatgggaactacataaatataacccgaccaaagccaaactaaatatctttccagttcaacttctccttagcaggagcccccacgtggcagcaagcctccgtttccacctcacacaagagaaaatgtgacgggcaggaactcaagactggaaatgaacggggacgttaattgattgtagggaaaatattttccattttgtaaattttacaaaaaatgtttgaccctgtggacatgtggttagggcccttctcagtgccttgagagggaaccatgcaggtagagggagggttcttagcattgtgggggtgacctggagattggcagcagggtgccaccaccacccctaggtggggatgagagggaggaagtcctgtgaccagagtccaggggccagagtcacctgctgggagcccaaacaaaggtgggactctggcaggagctggaactacacagaggaccacctctcctgctggagaagctgtctgaggcagaggaggtggagagctcccgcgccctcccttgcttccacctcccaggttcctcccaagcctctcgttggttgaacccagcccaaagccagcaggcctggggacctggacacctgagccagcagaggtcggcgtttctcccacacaaaggagggcacaagaagtgggaggcacggagggggatcaggccaggacccacacaggatgtgcaaacaggagctcccctctcttcccaccccaaatggcatctgcagccggcctcacttccctgctgttagacaggaagaggaaccttgttcccggcaccagctgcccccaccgccccccaccccacggaggcccctttcctctctggcctttgcttgcaatcattggcgacgctgatggaccatatcttctggggagtttggtcatgaacatggtttcccatttgttgtggaccaaactgtgcccttccccttgaattcctgcgttgaagccctaactcccaatgcagctgtaattgaagatagggcttttagggaggtaattaaggttaaatgaagtcatagggcaggaccctaatctaataggattgatgtccttataagaagagggagagacaccagagatctctcctcccccctcacttgtaaacagaggaaaaatgacggaggacacagcagggaggtgggtacaagccaggaagaggggcctcgccgggaactaaccctgacggcaccttgatccgggactttgggcctctcaaactgagaaatacatgtctgttgtttaagtcactccctccacagtaatctggatggcagcctgagcttaccaaggcaccgtctgcatcagccagggctctccagggagacagccaataggagatggatggatggatggatggctagatagacagacaagcggacagagagagagagagacaggcagacacagacagacaggcagacaaatggctagatagacaagcagacagagagatagagacagacagacacaaacaggcaaacagacaggcagacaaatggatagatagatgatagatagccaggcaggcagatagacacagacaggcagacagacagacagacagatgataggttgggttcagtgactcttacctgtaataaccagcacattggtaggctgaggccggtggatcacttgaggccaggagtttgagaccagcctggctaacagggtgaaaccccatctctactaaaaatagaaaaattagctgggcgtggtggtgcatgtctgtaatcccagccactcgggaggctgaggcacgagaatcacttgaacctgggaggtggaggttgcagtgagctgagatcacgccactgcactccagcctaggcgacaaagtgagactccatctcaaaaagaaaaaaaagatagatagatgaatggatagatagctagatagatgacagatggatgataggtagatagataattgataaatagatataaatgaccgatggacaggcagacatagatacattgattaggtagatgatagatggatagatagaagatagatggtggatgggtgggtagataggcagatagacagttagaaagatagatgatagatagataggaaggaatttattaggggaattggctcataccattgtggaggccaagatgtaccacagaaggccgtccgcaagctggaggcccaggaaagccagtatcgtggctcagtccaagtctgcaggcctcaggactgggaagctgttgatgtaactcttagtttaaggccaaaggtttgagagcctggggaactgctggagaactgggagttctaagtccaagggcaggagaggaaggcatcccacctccaggagaaagagggaattcaccttttctctgcctttttgttgtctggcaatggaatggtgtcatccatattgagggaggatctttaccactcagcccaccaactcacatgcccatctcctccagaaacaccctcacagacacacccagaagcgatgcgttaccagccatcccttaatccagccaaactgacacctgccgtcagccaccacacaggctcagaagaatcgtggttgcatggtgatggtctccatcccgtctaaagaagttgaagatgaactgttggcacaagccatcgttctttcaggctccttccagtcgttcattcttttaaaaatgtattcattgagcacctgctgcatgccaggtgctgtgacaagcactggggcacagcagtgagcaaacaaggactcttgtttcttggagtttacatgcagtagaaggaaacagaatcaatgaattcatcagttctagaaactatcaaaataggactaagagctgtggtgagaattaagataaggtgattgcatagaaagtgactgatggctgctttggaatgagtggtgaggggtcacagagatgatgacagctgagttgagattgggaagacaggaaggagccagcagtgcaaggactaggctggaagcaagcttggtgcattccaggaacagcaaggaggccagaggggctgcagtagagcaggcgaggaggaggagggagacgcaggtcaaagaggagcctggggccagatggaggaccctccctccaaagctcagtcatttcctccttaaaggagaatgtgttacctccaaaagtcacatatgccagcacagtgtctggctcatcatatgccttcagtaggcggtgagcatggctgttcttgttattactacatcacaattactaggaataatggagtcaccaggctttgcatttacagcaatgtgagggagtcagcaagcttccctggggaacccatctcccctcactaagttcataagagcctgataaccaggtcaatgtagtgagagctatagctgcccagtgtactggactctttagccacgggccaggacactttcatctcagcagaaacctctaaggggactggggagtgtgctgtggatgtttctgggttactcagacctcctggggagccttccccaccgcagctgctgcagggagctcagctgcagtgatgaactgcggctcagccttgtttatgggaaaaccctacatgggagatgggacggtttcctgttggttctctcggcctcaggttgctttcacaagtgcagggattctcacctgggtgtgtgaatggggctcaggatgccccaagggtatgtggagatgggggtcagctgtcttctctgatgcctctgaacctcctccccctgcctttctgcatctcattgcttcctggcctctctcactttgggtgctttggaacaacatgcaatccaatacacaggctgactttattattttgttttgttttattttattttattttggaaacaaaggctctgtcattcagcctggagtgcagcggtgcaattgcaactcactgcagccttgaacttctgggctcaagtgattctctcgcctcagcctctcaaagtgctgggattacaggcatgagctgctgtgcctggcctaggctggctttaaaagctcctcactctctctgcatcctgatgatacctacctcctggagcaggctcccagccattggcttcggatactttgtagctattattggccagttgtggcatgtgaagctgaggctcaggagaagggcagtcctgtccaaggccacacggctcagtgctaacactcagacttcagtgtttttatctccctcctggtcgcttccacccttagtgcatctctggaggcccaagggagctaaaggccaggctttggtcagctaagaatttaaaaaagctgtctctgtgctcctctgtcaatccatcactccattatctcccccgacaatgaattcagtttgaatttcagataaacaaggattaatttttagtataagcatatcccacaacagacttgggatatacttatgcctaaaaatgattcattgtttgctggccttagtagctcatgcctacaatcccagtgctttgggaggctacagttggagaattgcttgagtccaggagttcaaggttacagtgagccatgatcatgccactgagctccagcttgggtgaagcagcaagatccttatctcttcaaaaaattgttgattgtttatctgaaatccaggtttaactgagcatcctgtattttatatgagaaccctatataggtgagacccagagtcccaatgcccactggtaagcctttgcagggaggctctgtgggtccttggctggcactgatgccctgtgatgagcagggccatctggcaaggtggacgcctgctgcccatgcaggcagagcaaggccctgggcaggtatgagctgatctcaccttccccagcctgggagccagatactgttggcagcttgccgtcaagagaggggctggtcaccaagagaggggcggcctccatgggccttctttggcttttggctctcccccagccctcctcctaccccaaacagaggccaacggcaccgcaccagaaccagtgtgctgcctcctttggttggcattttgtagttgggtagactgtttccttctcacaggagctggtggtgccccttccgcttcacagggaggatggctgagacccctgaccttgacacagggtgctgttctttttttgttttgagacagagtcttggtcttttcacccaggttggagtgcagtggcatgatgttggctcactgcagcctccacctcctgggttctagcaattcttctgcctcagcctcctgagtagctgagattacaggcgtgcaccaccactgagaacaatgccttctacagtgtttattctcctgtaggagcaagttcctaaggcaaggaggttgctcccctcatggatgaataaattgactttgatccacagccccacgtgtcagccttgagggtggggaaaggttgttctgtgtctaggcagggggtgggggcaaggccaggagggcctggtgcccagtgtacctcttcaggacacaactccaggtagcagaggccaaggacagaggggaggagaagagggaggtggccattatctccttatctcagcttcctttggagataagcttgagtattttagttgtccactaagtctggagataagtctggaatttaaacctttgactttgatccagcccttcacagctcctgtgagcaaactgagcctcagaaaaagggagtgaagcctgtgcatcctggacgcccccaccccaggctcaaaccgcccccaccccaggctcaaaccgcccccatcccagctcaaaccgcccccatcccaggctcaaagcgcccccatcccagctcaaagcgcccccatcccaggctcaaagtgcccccatcccaggctcaaagcgcccccaccccaggctcaaaccgcccccatcccagctcaaaccgcccccatcccagctcaaaccacccccaacacaggctcaaaccaccctcaacccaggctcaaagcacccccaccccaggctcaaagcatccccaccccaggctcaaagtgcccgcaacccaggcttaaagcgcccccaccccagctcaaaccgccctatcccaggctcaaaccgctcccaccccaggctcaaaccacccccatcctaggctcaaaccgcccccaccccaggctcaaagtgggaaggagccacagggaaacaaacgggggaggcacggatgaccaggatgagggtctccatgacccacctttccccaggggctatctcaagagctttttaaacttttattattttttaatagagatggggtcttgctgtgttgcccaggctgatctccaactcctagcctcaagccatcctcccacctcagcctcccaaactgctgaggttacaggtgtgagccactgcacctggcctctctcaggagtttcaagaaaaaaaatgggaatagatttgtgtgtgtgtgtgtgtgtgtgtgtgtgtgtgtgtgtgtgtgtgttttgagaaagagtttcgctctgtcacccaggctggagtgcaatggcacgatctcggctcactgcaacctccgcctctcgggctcaagtgcttcttctgcctcagcttcctgagtagctgggattacaaacatgcaggctgattttgtattttcattagagacggggtttcaccatgttggtcaggctgatctcgaactccggacctcagatgatttgcctgccttggcctctcaaagtgctgggattacaggcctgagccaccgtgcccggccaggaatagattcttttctgtagatgacttctgtcattattgaaaatggatgtttatgcacaattgaattgtcataacgcctcatcctaaaaagctcctttttgagaaaatgtgacttttgatagaggagagactgtccaggcctcattcattgtcagcacaaaggcagagcaggggtgtggcggtgtcaccctcctctgagacagccccatccctgctctgcccaggggttcagaagtctggtctattcgagcccacagaggggtttggagtggctgtcttacatcacaggtggggtctgtaaggatctgaaatgacctttgagaaggcgggtgtggtgggtgcatttcaatcattaaagtaacaacaatgatacatcaaatagtgtctgctcagattctgagtgcctgtttaaacatttccatcttgtgacttgccagattctagcataacaacccaggtaaaagaaaaaatagctgggcgtggtggcttgtgcctgtaatcccagcgtgaggccaaggcaggaggattgcttgagaccaggagtttgagaccagcctgggccacctgagaccccacctctgaaaataaacaaaccaataaaagaccttcatgctctatgtctttcttatatctaggttccccaaattatatgcattggggaaagtccattaagagaagcccctggccgggcgtggtggctcacgtctgtaatcccagcactttgggaggccaaggtgggaggatcacaaggtcaggagttcgagaccagcctggccaacatggtgaaaccccatctctactaaaaatacaaaaattagccgggcgtggtagtgcatgcttgtaatcccagctacgcaggaggttgaggcaggagaatcacttgaacctgggaggtagaggttgcagtgagccaagttggtgccactgcactccagcctgggcgacagaaaaagactccatctctaaataaataaataaagggagagaagcctctgggctcctagatacatgggtcagtgtccacccctgcaaagctgctgtgcccaaagaggggctgtacttggtggaattggggcaaaagagcagggagggcactgggcagttgacctggtctccactactggaaaggggctgtgctgctggtgccctgagctggttccacaaggaagacactgcacagggcgccctaagtttgctctttctgcctaggctcaccctttcctctccaggaccagggagccccgctcgtctcctgtcttcggcatctgctctctggcttgtgagcactgcatttctttctgcttggaacgccggcccatggtgggtccccggactcctgccttctgctgtcttttgccatatctcgtcaaagtgtgttttatttatttattgttattattttttgaaacagagtcttgctctgtcgcccaggctggagtgcaatggtgtgatctcggctcactgcaacctccgtctcctgggttcaagcgattctcctgccttggcctcccgagtagctgggattacaggcgaatgccaccacgcccggctaatttttgtatttttagtagagatggggtttccctatgttggtcaggctggtctcgaactgacctcgggtgactggcccacgtcagcctcccaaattgctgggattacaggcgtgagtcaccatgcctggccaactattataatattgatattataataatatcacagccagataacggtgactaacgcctgtaatccgaacactttgggaggctgaggcaggcagatcacctgaggtcagttcgagaccagcctggccaacgtggtgaaaccctgtctctaccgaatatacaaaaattagccggagcgtgatggcaggtgcctgtaatctcagctacttgggaggcggaggttgcggtgaactgagatcgtgccactgcagtccaacctgggtgacagagcaagactccatctcaaaagtagtaataataataataataataataatatcacttattgagttttaattttgtgccaggcactgtgctagtacttgcgccatgtgacctcattgactcggaacaacctatgagtaagcaccatctctgtccccaaggaagctgagactcaggaaatggaagtcatctcccagggcccacagcaagggcctggcgaggtctgcgttcaaattctgatcatctgactccaggctttcctgcctcctttgcctcccaaaaactcaaatactttcatctgggatgactccagacagctagatttcaattgtcttctctccttctgagtatgttttattttaaaatcacataaagataactcacttctcaactggagccacggaatcgttagatgtcttggagacttttctagctacctctttgctggactcagacacaggcctgaataattaggtccaaggagctgaactggagccgctcgtggccagaggtcccttcctgggaacagcagtggcggcagcggctgcgctgagcctggcaatttgttcaagagcaggggatgctcaggctgcgctcgcccccttcttatgaacggtttgctttgcgtcttctctgtgccaagggctgccaggcaccagatgcccattttaggaaatcagaaaaataaacagtgtaaataaaacaaaaactccacccaagaaatctgagacagatgctgttttccccaccgtttctccacccccatgctgggtttggagagagtgggccagcatgtttcctacggataagaggccctggggtatttaacctggatggaacctcttctattttccttttgcctggtgctagggggcagaaggcaggggtggtgtccatctggcccagggaggaggatagggcagcctttgtcgccggcatcccctgcagagatgtctcagccagaagtgactccatcctcaggaacgtgtgtcctgttctttgctgggcggcccctccttaccccccattgtttccacagtggggtgtgctagatttatgggcagagttctggttcactctcagccccggacagcagaatgtcccagtagtgcactgatggtgtgtgcgtggggatgtgtggaacaggggatagtgaccccgtgtgcgttatatgcagtgcggcttccagtcgggtgtgtgaagggggtgctcatggccatcgtggaagtgagctcagctggggctggagggtccaggctcactgtatgccactcagcagccttgggagtggggttcatcctcctccccgctcctctcccctcctggtcctgggcagcccaccggagctgcactctgggccatctctcctggtcttaaggaggctgtcatttctgggaggcagatgctggcccttccatccttgcttcctggagatctgcgccgaggtctgcctttctgtctggagggactggccaggaacccctgggttttcctggtggggtttttgttgcttagcagtgagcagagtgagtgggcaccaagaggaggatgctgggtgaggtcacggacatggctggggcaggctgggggtgctggaggtgaattccgcagctgtgcgaccttgggcagtttgcccagccctgggcctcgcttcctcctctatgaaatggggcgggagcacctgcctgctggggttgtgggttgggtgaatcggagctaaggtacagctcacagcctgccgtcagaccctcgcaagcagaagtgggtgtccctgctcagcgtcctccggtccctccttcaaggctcagctttgtcctcatctcctccatgaagcctccctggttactccaggagtcacgacccacaccctctttggagccttgtgtcacacgcatttctcacggtgttgctttccctggaggatgggttcaactaaaattggggcccatctgggggttccctccagcaccagagaagctcaggcttagtagagatgggtaccctgtcaatactagttccgcgaaggatacactgtgctcattctgctgccagttgctgagtctggtgtcctgtagttatggaacatgtgtacaggcctgggctgctggacacgaaggccagatgggcagttcactctgcctccgctctgagcctttagaaacaagctggctgcacccatttccatctggtcacagtttaggagtggggttgtggaatggatggaaggaaggatgagtgggtgggtgggggggtgggtgggtgggtggatggatggatggatgatgggtggatgggttgatggatgggtggattaggtggacaggtgaatggattggtgggtgggtgggtgggtgaagggctgaataggtgggttgggtggatgggtggatggatgtgtggaggggtggtggggtggatggggtccatgggtgaatggatggatggatgggtgaatggagtaaatgagtgggtggatggatggatggatgctgcaagagcctttctggagggttccagggaggaactggcatctttgaccagcagccagcatggtgatcagatacagggaggtgtctgggtctgcctgatcccttatctcactgttggtgggactgggctggttatgtgtccctgaagctctctgaagggtggctgtatggcattgcccaggggacatccccagagtgccgtgctctacagcaatagggtggccgcctgtgctcccagggccgctcctcctggcagcctttcgggtttgcttggcttagcacctcagcaaatctcctcgagttaggacttgcctgccatgagcctctccaacaagcagccccaggccaaggcctgtgtgtgggcagagggagcgcatgccgcgggaggctgcattaatctgaggttctgtttttgttccctcctggggcaaaaggtaaaaatagcctgtcccactccatccccaaatccagcccggctgcacccagccctgggagtgaagggggctgggtcaggactgcccgtgagttgtagaccctggtgtagggaaaccctgattcataagacgggtggacatggaggaaggaggagactccgtccagcagagacacgcttgggtgcagcccagcttggagtctgatggacgtgggctcacctgtgtgcaactctcattcactgtgtggccacagggaagtgacactctgtggagactcagattccttatctgcaaaacaggggtagtagggcttgggggaggatgtgtgtgaaggtttggcccagggcccctccagcagccagacagcagtggctgtcatccctccagcgtccagggttacctgggggagtagggcctctgtccccagatgggccccgtttctggctctggaactcacagcaggagcaaaggcgaggacattcctggtgttaatcatccacccggagggagagcgccagtggccttgtgtgacctttgccctttgtctctgtctttaggaggcacgcggacctccagtggccggctccggaggcttggtgactccagtggcccaggtaggtggctcgctccgctctggccccacccagctcatgggtgtgtttgtgctggggtcccttcattctggtctgggacctgcctccccacctggcttccctggatgagtggggccacttgcccatttcccagggagacgcagtctttgacggctttggactcaggtggcttccaggcctgtcgacgctgccctgctggagatgatccttgtgggggcaggggcagccacccccaggctcagggagcaagcccgtgtgtgcgggacagaggagagaacaggagatagatagggctggatgatttggtttgagatgctgaggggacagatgtgccatggacaggtggctttggccgtgagcctctcggtgttggttcagtatctgtgggctccctgcaaccttgcaggatggaagatgctccaggatagagcagatacgtccggtgttatctaggaggaaataagtgggcctctggcagtggtcactgtgctactccttgtgctttttccatgtgtttggaaattttccacactaaccagtagggaagggaaacagatgcacccatcagagctctggggctggccgtccaggacacgagttacagcttataggcttgaagggactctaccaacactgggtgcagcctgggcaagggagtgggacagagaggtcagggctctgcctccagcccttgccccccagggctgagtctgcgcgtcatcttctccccactgggtgtccctgatctcccctgcctgaccccagtgtggccatgctagtgcctctgtttctgggagcctacgttgttcttggctgtcacttccagcggccaggctgggacaggtgcccatctagtggcttttctatttggagaggatgatgggtcacagcaatgaatggacttacctcccctaggagacgaggagctctgagaagagcagagatggcgtggtcacctgtgcatatgtgctgggggccaactgggtgccagacccctggctgccatcatggtggcagacaggcagggactgtgccttcatgaattagccattctagaggagacaaagttaccaaaggacacggacccggagtcaaatccacacaaatagagcgcctgtggaccagggctgccttcagaacaaggtgagacagccgtcctgccaggacaaggcgcctacgggggcaagggcatgtgcccatctggagccgccacctccatgctctagaccagctccgtctaatagaaccttctgtgatggtgggtctgttctatacatctgcactccgccatcctgtatggtagccgcttagccgcctgggtctattgcacactcaaagtataaatgtttacgtttactttattcactcatttacttgcatagaattatttatttattttaaatggatttccacttatatctacgtgtggctagtggctatgaaactgaacagttccagaccacactggcacctgagacctcagaattctagacccaaagcctgcttctgatcctgagcttgcttctgtggggacagcacagacgcctcctaagtctgccttccagaggtggatgcagtgcccgtggactgtgcaccaccaggcctggacagtggagagggtggctttttacagggagtgggagtggaggggatgccgtgtccacattgagtgcatgtgaggccccttgcagtacaggatgggactgtatgtgggaagaggggggtgatgctctggctggaggcccctgggcagctgcatgattcagcgctgtggttaagaggggctccgcccatcgcagtcatgttgggcactaaccactggacagcccagccgctgctgtgtttctggggagcttttctccggctccgcatctgatctgcctctccatctccttccctctcattggccagcttctggtggaatgggtggggagggtcccccagttcttgtgggggttgcatcttgggaacctggcaccctgggctgcatggacacagcctcccccggcggttgcttccctctgctcagactggctggttctgtgctgtcagcacttggcagccacgatcacagctcagcttggaagcctaaggcataatttgctgaatcccaaagctgcaagctggtgatctgggtttgcgtgggactgcctgctgacacacggggtcctccctctgtgggcctctgtgggctctggcccgagacaccctttcctcatcttcttggcttctttctttctccctgcctcccttttgctaagaccctggtccaggcaggagttcattcctagacgccccagcatctccggcctccccatttgacactccccagacgactgtctgccatcccatcctcccagcccagcttctctgtagatccacatctggccaatctcctatgtctgggactcttgccctccccagaaggacgaaggctcttctcgaggttgtgtttgggactgggccagggatgacatttctggcaaaagcttaaatgacaccatgatcaacgctttggtcagctcacacactttctttccttttaaaaaaaaaatggaattcttagagctacaaaacaaaaatgtaaagaataaggtaataaaacacctgtgtactcaccatcccgcttaagaagtgagacattgcaggtgtagccgcagccctgggtgaccttctccatcctagccccactcctgctgcggtgcccgcccctctggattgggatctggccccgggcaggcacatctgtgctgggcagtggtgtgtctgagaagcctaggtctccttttttttttttttgagatagagtctcgctctatcgcccaggctggagtgcagtggcaccatctcggctcactgcaacctctgcctcctgggttcaagcgattcttctgcctcagcctcctcagtagccaggattacaggcacccgccaccatgtctggctaattttttttgtatttttagtagacacagggtttcaccatgttggtcaggctggtctcatacccctgacctcaggtgatccacctgccttggcctcccaaagtgctgggattataggtgtgagccaccgcatccggcctggtctcctcttgcatacggtcatcagcatcgtgtgactgagcagcctaggtctgtctcctcttgaatgccgtcatcagcatcacatccttggtgcctcactggagtcagtggctgccctgcctgtgcccacaacgtgacggcgtggagacttatccgtgtagatccacgaagccttggttcacttattttggcagctagcgagtgttcctctgtgtggggaggcagagtttgcccgtcccgtggcccactggtgacatcgccgaaggtcttctctgttactagtgctgccgggaacgtgtgtttccccaggtggatttggctgggctgtggagatgcgcttctcagcccttctagatgttaccaccacgccctcccgagtggccttctggtaggctctcccatgttcgctcattttctgtgcctcaggcagccgcctctctgactgagcgtccagcggacttttgccctgtttcccacggtgcacggagcatttcatctcagtggtgcctgagcttccctccctctggccctcagaccccggctgggatccttggagccaactcctctgcctgacatcccgtgtcgctaggtcctgctcttccatcttccaatacctctggggtgtgtggccttttccccagtgcccccatcatcccttctgtcctaggttgaaccgtgtcccccacaaactcatgtccaccaaaaacctcagaatgtgacctgggagttggagatggggtctttgcagatgtaagtagttaaggatcttgagatgaggtcattctggattagggtgggccctaaatccaacaactggtgtccttaaaagaagcagagaggccacagacacaccggggagagccacgtgaaggcaggagcagatgatggagtgacgcagccccaggccagggagcgtctgggaagaggcaaggaaggaccccccccccaccccaccccagagcctccctagggagtgtggccttgctgacaccttgattttggacctctggcctccagcatgggagagaacccgcttccattttttcaagccccacagctgtggtccattatggcagccacaggacactgatgcacctcccacctggccgctgtggatggacgaccccgcccgcaggaagtctccctcaagcactgcaggtgtctctgccctcacaggggacgcctgcacaagtaggtgtgaaaaaagggccctgtgggggcaaggcctgggctggtgctcgctgcctcccttcatcctatgctagttcccatgcctcttccggcaggagtgcctggctccacctggtgaatcagagccaaactctcctgacaattggctgtcacttatttaactgccaccatccccaggagacagaaaatgccagaagggtggggcctgtgcagtgcctcctcgctatttccccagggcaccgtgccacgttgcctcaatgcacagagtagctgctcaaagtgtgtcggacgaacaggtgccccatgcccagccatgcagacaaaagtgtgccacgtggagggagctggtcgtggaagagaccaccagcatcttggctgcccgaggaccttgcccctgggctcttgcaggcacccctagttcattacttcctctctcacccatagctacccactcttcctctatttctctgatatcagccttgccacccacccaggtttgcaagcaggaaatctcagagttgaccttgacctctgcctccccagcacccccaggtctcaacaggctgccaagatctcatcaactcgccctctgcatactgacccttggacaggctgccccggtcacggtcatgtcttggttgggcctccatcatccctccttggaccagcaggtgccatcctccccacccctgccctgctgtggctccttcccctccacggccaacatttagaggacgattaccacttccctccctgtgtgctggggaccgggtgataggatccctccacccgatcatttccattagacctgggccgggtcttcttactcatagagcccttagtttccgcccccaaagcctcgagggtggattcgtgctgccgcccagcctggccctgataccgctttccagcctggagccccctgcttctgcgctcctggctctgagtgctcgggccccccctggatgggttgccacttgtcctctggaaagcagggcttccatgctcctggacctcctagctgactcagtgactttgggccatcttgtcacaccccttctatcagcttggccttggttatttctgtgtcctccatagcctcggaccagagccacggcgggatgctttcctggtgcgtggcaggcagtcaggaaatattgctggactgaccttgataggagatgcttgggagaattgcccaaaaaactagcttaaaatgcaaatattggccttcttttgcgttggctaaagagtagcatttctccgtttgcctcccgggtaagaaattgatggcgaatgcaatgtctctagggaggagaagaaggtgacaaaaagggtctgtataacggggcacacgctaggcatttgtgactatttaagtttaaattataacataaatgcgaaactctttgccttggtagcccttccacattgcaagcgttcactgccacatgtggctgccatattgactacggcagatacagaacattgacatcattgcggagagttctatgggggggcgctggtttagatcatcttcacgttggatccacaaattcattgtttatccagtgaacggttactgggcacctactgagcaagcaggatgaaagacacccgctctcgggggagtcttccgttggctgcagagaagcttaaactcaggggacctggggcaaactctgcaagggcccttggcctctgcacccccagacctccctcgctctgcaggggcagtcgggggccccctctaggaatggagcgccagctccagctcctgtcaggctacagcccagatggttggctgagcacgagcatgtgagagtggaattgggcccaaccgggctgcttctccccgttgtcttggtttccttccacgctgacctggaaggactcctaaagcaacaggcctgcccaggcggtttgcaccagtaaaccctgcagcggccccaagggcagagatagctggattgtatttatttaggaacagccaaagtctgaggcacaataaaaagtggagaaagattccagagaggaatgcagctggcctcagcctgggaatccgtcttgcttgggaggctgtaggcgggccaggctggggccagcctggagggtcttggctggctctgctggcaggtacagtagcagggtcagcaggagggagtccaggacggagctccttcatttttaattcagggaagcaaacttcagtggttgagtctgaggatgagcaggaaatgaatggaaaagtcttttttttttcttttttctttctaggcagggtctttctctgtcccccaggctggagtgcagtggcacaattatagctcactgcagcctcaacctgccaggctcaagggatcctcctgccttagcctcctaagtagctgggactacagttgtgcgccaccatgactggctaattcttaaaagaaatgttttcaggctaggcatggtgacccatgcctgtaatcccagtacttttggagccgaggtgggaggatcacttgagctcaggtgctccagaccagcctgggcaacatgacgagaccccgtcttgactaaaaatacaaaaagttagctgggcgtggtggtacagccctgtagttccagctacccgggaagctgaggctgcagtgagttgtgatcacgtcactgtcctccagcctgggcaaagggagtaaggccctgtttcaaaaaaaaaaattttttttttttttgaggtggagtcttgctctgttgcccaggctggagtgcagtggcatgatcttggctcactgcaatctctgcctcccaggttcaagtgattctcctgcctcagcctcccaagtagctgggattacaggcatgagccactgtgcctggactttttttttttttttttttttttgtagagatgggatttctctatgttgcccaggctggtcttgaactcttggcctcaagtgatcctcccactttggcctcccaaagtgttggaattacaggtgtgagccaccacacccagcaggaaaagtcactttttaaagcgagaggttgtgcgtcctctatagcttggcgctcatcagcatggaggatttactggaacgtgtgttaggtgaggggacatggaagatggcagcaaatccgagcccagagcatcagaaagcatgctttcagccaaagatgcgttctctccacctccgcgcagcacccttccccagtgtgtactcctggagcaaggtggggccgatcctacgaagaccctttcccgaaggcccctgctgcccacatcagtgtcacctggaccgcctgctcccttttctggatggctggaccagccccagggcctcctggcctggtgtggggagcacagtccaccctggggaatgcctggtatgtgtcccctccccactgggtaccaggggatgaagctgtgcttcgtggaaggggacagaggcgctggtgcccaggatggtgcacctggggcggctgaactggacctggctcctactgggcccctgtggagcccagattgttgtgagaaggggtggggaaaggcaggtgatccgcacctttcacttttgtttcacatgggaacaggggcttatcctgcacacatattcagtttggagtatgaatttccatgaagaggaaaatctctattaggctctgatgtcaggattgtccgtgagggccgggccgtgttctggggcaaggacaggagtggagggggcaaccagggaaggcttcctaatggaggaggcatttgatagcatcttgaaaaagaagcagttcctaggccaagccagagactgaagaatgaccacctaacttcttttttttttttttgagatggaatctcgcgctgtcgcccaggctggagtgcagtggcgtgatctaggctcactgcaacctccacctcccaggttcaagcaattctcctgcctcagccttctgaatagctgggattacaggcatgcgccaccatgcccagctaatttttgtatttttagtagagacggggtttcaccatgttggtcaggctggtctggaacccctgaccttgtgatccacctgcctcggcctcccaaagtgctgggattacaggcatgagccactgcacccggccacgaccacctaacttctttctacaagatgccccctggctgacgcaaagcaggttgagtgagtgtgacacttccttcctgtctgtgggttccggcctttccagagcccggccagtgctattggagacaaagtggccttcgctcttccttcccgccctgccaggcccagcctgtgccgctgagccccactttgcaattaagaggagctgtgaaccagtgatgctgatgtcgcagaaaagtggccaggggtctatggggggtgaaggacagggatgccgccctgagaactgtctggaaggggcttttgggtaacagtgcccactccagggtgtgggcaggctggggtggctgggagctgggctcataggctggcacaaccagagtttcccaaagccgtgggcctgagggccctgccttcctgggacagcaacctttggtccaatttgggaaaaggtgggttaaaccaagcccggctccctcactgtaggattactcagtgcgtttagtatgcaaatgtgcctctgaatctaagacaggaccacagaaacctcttcagtgttcctctggagggagggaccgcgggggatccaccgcaggggcctgggtctgcactggcctggtgaagtgcccccttagtgcttacaccatgcgcggtgagaggttggccctcgcctcccccaccctctgctggccttacctcaccacctctgcactcgcctcccagccggctcatgactaactcctgcctcttcagagccaatcggtgctgccaggttttccatttcaagtgatcccccgcctgggccaaaatgtttggattttcaggcacggaggggagatggacctcaggccaaaccatgctgggtaaaactgagggtcaaggctgtgctcagcaagtgctccagccctggccgtcaaacccatagtgtgcacagcgtgcaggaggtggctgggtgaatgaactcagtcatagcccggcccctcactcggggctgttcccaagttcccaccgccagccaggctgggtcagagcctcgtggggccttcctgggcttccctgccccacagcaggagttcgtatggagagtctcgagtgaggttaatgggttttcttcctcttctttttttttttttttaatttgagacagggtctcactctttttacccagccagggtgcagtagtgcaattatagctcacagcagcctcgaactcctggcttcaagcaatccttccgccgcagcctcccaaagtgctgagattacaggcacgtgccaccttgcccagctggggtttctgctttttactttttctcttgtttctaaactcaatacaaagaaagatattacatttataatcagaaaaaccaacaaggaatattatttcaaaattggaaaagggattaaagaaacaaaccaagaaacctctgcgattcctgcccatcggagtcagtggttgttagtggttggcttaacacaatgttttaggaagaaatagaataacagaaagcaactccagtgagctgagccctggctccgtctgtggcgctgcatcagtttcctgcagctgctgtaacgagtggccacaagctggctgggtcacaacaacgcccagccatcctctcacagctctgcaggccacacatccgagatcagggtcaccaggctgaaatcagggtgtccactgggcatagccctctggaggctctagggcaggggttcccagccccgtgtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatggtgagttgtataattatctcattatatattataataataatagaaataaagtgcacaatcaatacaacgtgcttgtggccgggtgcagtggctcacacctgtaatcccagagtgaaactctgtctcaaaaaataaaaaataaaggccaggcacagtggcttatgcctgtaatcccagcactttgggaggccaaggctggcggatcacgaggtcaggagttcaagatcagcctggccaatatggtgaaaccccgtttctactaaaaatacaaaaattagccggacacggtggcaggcgtctgtagtcccagcttcttgggaggctgaggcagaagaattgcttgaacccaggtggcggaggttgcagtgaactgagatagtgccactgtactccagcctgggtggcagagcgagactctgtctcaataaaataaaataaaataaaataataaatataatacacttgaatcatctcaaaaccatctccccactccctggtctgtggaaaaattgtcttccctgaaaccgatcccaggtgccaaaaaggttgggggccactgccttcatcgcctgcccctttgagcctctggtggctgtgggtgtcccttggcttgtggctgcatggcccttaccttcaacaccagcatctacagatctctccgggccccatctccacttggccatccctgtctgtgtcaaatctccctctgcccccgtcttgtatgagcaccgagactgcctttagggaccacctagaccatccagggtgctctcgccacagcaagatctgcaactgaatcacagatgcaaaaactcttgttccaaacaaggtcccatttgcaggtctagggattaggacatgctatccctggggccattattcagccttctctcgtgactatgatccctcccttcctccccagcctcccacctcggctgagatgctgtccccacctccctcactgtctggctgcctgtggggctgtcctccaggctctttgggaggaggtggttgcttgatgtctcccagaaggctgggaatggtcctccccaccccccaggaagatgtcctttctgccaaggagattgcatttggggtcctatcccaggcagagagcggacgggactgtggcctgaagtggcacttcagggcctttggctctgtcatctagccgagggctgtgcatgggcctcacctggtcacaggtaactcacctggctctgtggggcagggattgtaaactcagaggcctgcggggtgtgtcgaggtagaggggtgcaaatattgtaaatttgttgggggccttggggagcagcacagactgaaaagtgttttgtctgaagagcagaactgtcttataccagccctgtgcggccaggcaggaaggcttccgtggtgcggccacgcgtcctccctttctcaacagaagctgacagtctggagttttcagagagattgcctgagttctcagccttggcacaaacacacattctctttaaacaggcttgggccaacagaaccagcctccgtgtctcgggtttgaatgaacccttgaggtgaagcttaaagacagagaggatgcccctgattcccaccccagggacccacattgtaaacccccacctgctctgctgagcccttggcctcagcatggaccctgaccatgtgctggtggggaccccccaggtaagtaagcagcctctgaggaccccggatgaacagtggggaacagcactgatcccccagtggggccccgagttcccggagaggaagactcgctccctcccaggggacggctagagactcactgactcatgcgtgtgtggtaggaatcttccaggaagtccccgtcccgttcgccctctctgcctgggcggggacggcaactgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcaggtacgcagacagccccctccccatcggccgccccccactgccctggactcggggctttatttatgcctgggggaataagcatgcaaagggcgcttttgctcatttttcacagaaatatttcttttctttttgacggttccaagctcgtgggatgaactccgtctcagaagctaagctctcctgagtctggcttttatttaaactcggctctcctctctcctggctacttccctttcattttccagtgtgccattcttgcatgtcatggccactgtcaatgctgaggctgttggcgccgaaaccttgggagggtgtgggggacctgcccccctggctcgggtctggggcggcggcgcttggacctggctggtggttggtttgtccactgtgtggtttgttttttgcttccagccaaagtctgtcttcaaggctgcctcggtctcctacctaaaatagcatttctgtgccttcctggcagttgattatagagggggaagctcccggcgctcagaggagcctggcgtgtgtgtgcacgtgtgtgtgcatgtgtgtgcgtgtgtccattcacgctggcagcccccttgccgcaggcacagacccatcagggcgtgaacaggcaaatgaagagaaagggggctcccctgcctttagttcaccccagctttccaggccctccctcccaggcccagcctccttggtcccttcactcacatgcggtgccgtggctgccatctcacgtggccagcgccgtcatcggtaattagcagtgatgacagtttctgccgctcatgccgccctctgagcccagcgctgggagacatggggtggctgagccaagctccaggctttgggtattctgaagtgacctacgggccatggagcgggaggtcgctaagagtgtcaacccctacgtgccttgggccctggtctgttggttgccactatgtgtgtgttggggggtccctgagaggcctgagagagggaggcccatctcggtggctcctctctaggacgtgtggtcccctccaccactgctcccagggccacatctttttttttttttttctttgagacggagtctggctctgttgcccaggctggagtgcagtggcgcgatctcagctcactgcaagctccgcctccctagttcatgccattctcctgcctcagcctcccaagcagctgggactataggcgcccgccatatttttttgtatttttagtagagatggggtttcaccgtgtcaaccaggatggtctcgatctcctgatctcgtgatccgcccgcctcagcctcccaaagtgctgggattacaggcgtgagccacggcgcccggcctcagggccacatcttgattgtcacgttgggactggtggagcgggtgtgtgttgtgccgctgagcacacccagtcgggcacagcaggcggacctcaggagggggccaggggagacggcagaaggcttgggtggcagtgaaactgcatcttatctgtttgagctcgggggctcaggcccgctgggacgggtgggtgtggagcccagcgtcctgctctccgcccagcaggagccgcagggcagggagcgctgagagggaccttcgtcaggcttgcacagtggagccgtcctcggagtgaccaccccaccaggcagcctgggcagaccacagtgggtcccctgcctcctgggccaccagccccaggaggacgtcactccacccgcctggctggcaggggcctcggggagcctcgggttcggccttcactttatagatgatctagccgaggcccagatgggtgaccagcaggggatctgagagctgagcagagaggcgtgggtttgggggtggtgctccctggggagctggaagtgatggcaccctcccaggctcacaaaacacgggcttttcatgaactgaacaaaacactctttgaaagcagccagtgctgtgccccagagaccactctgatccctgctgcccttggctgaggacagcacagccagggatgaagcggggacctcccctcgggctgtgccttgatgaaagatgctttctacaaaatcccattcggatgtgttttcatgtaagaaaacgtacatttttagaaactcagttgtaaactggctgccttccgaatgaacacgacagtcccggagctgtttcccttaatgaggttctcgtcctgggcaaactttagcgctggtctttaattgtcactgaactcccgcacagtccctggggaagtgacttccttcctgtccctgctgggtggccttgagcaagccacttggcagctctgggccgcagttccgtcatctgcaaggtgaggggtgggagcggcacggcccctaggcagcgcccccacctcctgcgggtttctgcgcgtgtcctgagttttgtgggcgcctcttccctcactgaggggctcttcttctctgcagggcatggctcacgccgcgttgtcaggctgcaagccactgcgagagctgctctgatccccaagcatgctctggcctgaggaggagccatggggaggacgctgtgcctgtgtgacagaggcctgcccggcagatgccggcccgctgacttccagacgtggctgtgggtgcctcatgccccactgggctggcgtgtgaggcgtgtccagctcaggctgccctacagctgcccaggaagggtttgtgggagggggtggtcctaccctggtgagtccacggtggtctgccagccccagggaaggcttaggagccccaagacctgccctcttgtccctccctcggcagtgtctggctccggtctggtttgtgaacgggggcctgggtactctcccgccctccctgggggctgtggccttcccctgggaaggtgctggagggtttgtcagcagggccggcatgagtcatggagtggtgactggccgctgaggcatggaaggccactccttccagccaagggtcggagctttttttttgttctggaacggctttgtggcttttacaaattaagcagttttatcttgttccaagagcttgtatttcagcagggagagagtctccaagaagggaactttccactggggagctctgttgggctgggaggctaggaacaggccacgagggagggctgcaggcaggggaagtggccgtctgtgcatggtcatgaatgcaggcccggggtcctggagggggcttggccacgctgtcgctggacgtctgtccccaccagggtccatctgatgcagtacggcacagggtaaagcccagctcctcttacggggttcctgggtcatcagtgggcggggaaccgaggcctcctggagggcggtgcctcagccctcacccctccctcctgtccctcgctgtgctgtccccgatggcctctgccatcccctgggagttcttacccctggacgctcggtgcctgtccggtctcaacctctccagctctgcttttccatctccgaggtgagaggcctggcctgacgcgctctgcacccgcttcctgcccagccccgtgggaactctggtccctgtagtggtttcctggggctgccatcaccaagtgccacaaactgggtggctcaaaacaccagacatttcttctctcgccgttctggaggccagaagtccgaaatcacggcatcagcaggcctggttctttccggaggctccgagggggagcctgcttctcgcctctggcagcttctggcggctcccgaaacccttggcgttccttggctcgtggccacaccactcgacctctgcctccgttgtcacggggcctccttctgtgccctaaatctccccctgtctgtctctcatacggacagtctttctcggatttagggcccactgggtaacccaaaatggtcccatctcaagatccttaacttcataacgtctgcaaagaccctttttccaaataggccatgttcataggctctggggtggatgtaaattttaggggccacctttcatccccctgttgtccccgtgtgtctggatgcacagcatggttccatgtcccagactccttgctggacccctctggccctttggggtggcctttggccttttccactcgtttctgtgctcctggtgaggtgtcggggtcgggcttagcccctgcaggaattctggggacagcatggagccggcaactccccaccaggcgtcttcctacctgcccagagctcatggttgtgaggggtctctccttgtggttttgatttgcaattccccagtggttagtgatgttgagcatcttttcgtgtttattgctcatttgcacatattcttgcagaaatgtctgtccaagtcctttacctgtgtttgatttggatgattgttgttgctgagtgttaggagatctgtagattaatatccagatactaatcccatatctgacctatgatttgctgccattccatggattgccttctccccacgttgttagtgccctttgatatgcaatttttttttttttttttgagatggagtctgactctgttgcccaggctggagtgcagtggcatgatcttggctcactgcaacctccgcctccctggttccagcgattttcctgcctcagcctcctgagtagttgggattacaggcacccgccaccacacccagctaatttttgtatttttagtagagacggggtttcactgtgttgactaagttggtctcgaactcctgacctcaagtaatccacccgtctcggcctcccaaagtgccggagttacaggcgtgagtcaccgcacccaggctgatatgcaaatattttaaacttctatgacgttccactttatctatttgttcttctgttgcctgtgcttttggcgccatatccaagaaatcattgccaaatgcaacgtcaggaagcttttcccctgtgttttcttctaagagttttgtggttttagctcttgagtttaggtctttgatgcaagttgagttgatttttgcatgtggtgtaagggctggtccagcctcatgctctgggctcttgattcacttctcttcttttctcacgcccagctggttccgctgggtggcggggaggagtggggaagtcccgggctgggcctgcactcgatcatcccctctcaggccagccagggagtctcagctcctgcccaggacctggctggacgtgctccctaccgggaaagcctgggccgtctttctaggctgatggcagggccagcccggggcgtcctgaggcctgccctgcggacatgccccttgttctaggtggtgtggctgcccggcctgcgtgtgagaccagctgtctgtgcttcaggccatggaggctgagtgtttccagcctgtccccttgctcggctctccctctggggaagcccctgcagcccattctctgcctccgcttctgccatctgtgcctttgtctgcttcctgtttggaggtggtcatccctggggccacccctcatgatctggacacaagtctccatcctgaagccaccacccaaacccctgtgcctcaaacccctcccacccaccacatgggtttccactgtgaccaactcagcagctgatgaagcttcccttggggctctcctagcaacggggagctggctttcccggaggcctggcctctccctaagtggaagtggggcgtgagggtgtcagcctttttctgctgcctggtgctctaggttggcttgtcacccctggaagcacttgccatccttatacagcaccccacacccacctccccgcctcctaccccttcttccaaggggtcatctctgcttccctccccacccaacctcacccatgtggtccgcccagcaacctttgacccccaacatgacaaaataaacctcccttgccggtcactcattcattcattcagcattgggtgctccctgtggacttggcgctggggtcccgtggaggacaaagccagacacagtccttgccctcatgggactgcacaagtgcaagaccacatcagtaaacgtgaaacacaggaagtgacaggtgtgacaaaggggaccagtggcaggacagaacctgcggttcgtaggaccaggtcaggagggctgcctcggggggacaccttcgggctgagcgcagaaggatgaggggagtaaaccaggctcaaacccagcaggcagaggcgatcgctgcaggcaaccggcaatgtgttcaaaggccctggggcgcggggggctgaggccggcagcacggcaggaagtaagactggggttgaaagagactgactgtcatgttgtgaaatatacacttggttttcatctccatttcctggcacacaactcctaaaatccttggaatctccaaagtgatgtctttttggatgctcatgattgacagaccagctggcagcttcaggatggttcccagggaagaccaggtagaatcacaaggttcagcaccaccccgcaacctccaggtaggggagaggggctgaaggttaagcagatcatcagcggccaatgattgaatcaatcatgccttcgtaatgaggcctccgtgaacactcagaaggatggggttccgggagcttctggatggatgagcatgtggaggctcctggagggtggagcgcctggggagcacatggaagctctgcgtccctcccccataccttgccctacacatctcttcccctgtatcctttgtaatatcctttataataaactagtaaattccatgagccccaggaacatgtgtaaaagaaaaaaaaaagaataaaccatagctgctgtagcaagttaatcctaccagcactggctctcatctgccgaccttacctctggcaatgcctccctctcctgggctcctgggacccctccggccccaccacccctcctgtagtggtctcgctggctgctgccctcaggttagtttatttttacccggcctgctcccaccaggggctgaggcctccttgctcactccagcttcctggcccgtctcttgctctgggcacccccccactccgaacggccagagcttctgaagccgctcgctgtgtgcccccgcctggccccatgcatcccgcacggtgctccccagggtctcccactggcaagggcattggcatagattctggggctgccttggttcaagcccaccctgacttggagcctgagggtccctgagggggtcctgaaggccagggcaggcaaggctggcatgctctgggcagtgggggctgggtatgggaggggatcgtgggtggggagattcctcttaaccagcggcccacgtttggagactgatttgggctccaggctacgccttgaaattgggacagagagtggcgcagatctcagcccggagactccctctgcctgtggacgccctcatacctccatccgtggagccaccctcctctttttttttctaaatggggaaactctgacttgaacactgaataaacaacacaccctcgaaatcagcgaagaggcactggctctgaaactttgccatgaaagcttgaaaatgctctttggaccgatttgctggaacagacgggtgtgatggggctgcggggtttcaggtggcaggaggcgtccccgtgcctagggcatcccgatgctcagagtttccccgtgcccagtgtgtccctgtatccagggcatccccatgcccagggtgtccccgtgcctagtgtgtccctgtatccagggcatccccatgcccagggtttccccgtgcccagggtgtccctgtatccagagcatccccatgcccagggtgtccccgtacccagggtgtccccgttcccagggcgtcctgtgcccagggtgtccccgtgcccagtgtgtccctgtatccagggcgtccccatgcccagggtgtccccatgcccaggcactgcctctccccactttcctaatctccctccaccaacaggtgtcagctgtgaaatgcctgctgtgtgtgtcctttggttgagttcatcttgtgctcttaagttcctgttagacacaggcaggctgctttagttcttctggcaaatgttttgttgttgttgtttgatacggggtctcactccgtcacccaggctggagtgcagtggcgccatctcgcctcactgcaacctccgcctcccaggttcaagcgattctcctgcctcagcctcccaaatagctgggatgacaggcgtccgccaccatgcctggttaatttttgtatttttagtagagatggggtttcaccatgttggtcaggctggtcccgatctcctgacctcaagtgatccacccagcttggcctcccaaagtgctgggattacaggcatgagccaccgtgcctggcccgtctggtgaatgtttattgaggcctactatgtgcagcccctctcttaggtgcttggcctgtaatgaggagcaacaaagacacagtcgctggtcgcttgttacttaacagttggaactgagaggcagtccacaaatgagcaaatccataggtggttttagatgaggactgtgaagaagctaagaacaggttgctgggggtgcatatctgtgtgtgtggcgaggggattaatggaagccctttctgagtggtgacactgagctgaagctgtaatgaccagaaggacccagccaggccaaaatccaagggaagagcaacctggcaaaggaaacagcaggtgtgaaggcccgaggctggagcctggggaaggtgggagtggctggagtgtgttttcagagacgggccatggtgacaccaatgcgacaggcagggccaggtcgtgccgggccttggaggccctggtgagggcttgattttattctcactatggtgggacctcagtgccctgtggctgctgagaatggccaggggcaggcagggaggcctgctagggaggaggctgctgcaggccctgcagctggagagggaggatcaggatctctttagagaggaagttggagagggaggatctctttgattgctggatggacccacctgcctggctgcccccgtcagcatccagcagaggccactggatgctgacaggtggccggccctgcccagccttgcactgccctgtgctgccctggtggctgccggctttaggaggagcgcttttggtgtctgagcccagtggtcctggctgtggtttggtacacttggccgtgggtgaggccaaggtggtttggatcctgggaaggttgggtacctggcagcctcaaggcaggagctggggtgttggaggaggaagcacgctcatccctcgttccttcctgtttcgtgggatgctgagtctctgggcagggacatggtgagccctggtgtgatgcacttaacacctgctggtgcccccatccccaagcaggaaccctggtgcctggtgcctgaggactgctgtccaccgtcccaccatccttcaggtttcttcccagcctctgactcggggcaaggttcagatatccagaacattcttggctggctcttggagctggggtgaggcagaacctccctcccatatttacagcaccagccaaggcttcggggtttggacaccatccctgggaggggtgagcaggacaagtgaggtctccagacttggggtggcttcggactggccaggcaggtgggtgggggctgcagtccatgcccccgctccaggcaacacagtcgagctgcagcccccgctccatccccagctggggctccctgtgctcaccttctgcttccttcctctccctcggaatggggggtggacactccaagactagcctcccagccactctccctgcctcctgcctcctctccttcgggacagacccctgtgatcgctgggtgttcctgatgctctgtcccctctgcgtcctgtgccgtgggtgagagagggcttcggggggacttccccctcttggagcacctgctgctccgggtgcctctgggggcgggcccccacctcacattgtggagctggtgtaggaaggaaggtgccgggagccagctccaattcacgtgctggctgtggccctcaaggtgtggatggcaggaggtggtgagacagggactcattgatcatgggactgacaccccctcatgttgatgtgggccctgagccataatctcaccagctcctgagttttggcgctgctcttggcgatggcgtggactcagccaggctctcgggcagcctttcctggattcttcctccgttctcccctgggcagtgtttctgttcacctggaaaggatgggtaggacttggagacaacagggattcaaagaagtcgggagtgggggcacctgtgcagctcaccctgcagaacagacaatttggttaaagcctaaagcctgctgtcaggagcctcgcttgcctctcagagagcacatggcttgaccatcacggggactgggggagaggcacaggcatgcctgtccggcagcagaagggaaccccgggcctgggcctctccattctgtggcgttgtctttcctcagagttgcactgtctccttcactgtccctgcctggccccagtgctcatgtggcttgtggccctcagtctgggcttggtctcccgcaattcaccctgcccagccccacacagcttgtccctccagctgggaatcggagctcacctggagtcccaggcagcagattcgatgcagtgatgcagggctgtcagccatgccagcaggccctgctgctcacagagggatgggtattgctgttgacaataattaaagaactacggcttcaggctgggtacagtggctcacacctgcaatcccagaactttgggaggccgaggcaggagaatcaattgaatccaggagttccagaccaggctgggcaacatagcaaggctttgtctttacaaaaaataaaaaataataataataataaaaactacagcttcagaatgattgacttcagcatgtttataaagtcaagggtcttcagtgtcctgggcctatgtcactgcgtcagagggagagaggaagaggctggggtgatgggcactggggcttatgctcctcctggaatgggtggtcttggactgtgcctgtgtgatatgtttgtcgagcgggggcggtgtccactgaggactggatgttgaggtgtgggtggggggaggttatgaagcactgggcatttcccgtgcaccagtgccccgagattgcagagaggggacccgcccagcctgggcagggaggcgggtggcagcgaggaaggggagaggaactcgggtgcagaaagcctttcctccagcaggtggcgccgcaagctctcgagagtccagctcctgcggggtttgcattttcactgaatttgtgggcagaggctgcctgggtgtagtttccgccaactgtgactgctcactgcgggcgaggggaagtggagtgcagagaatgcaccggagggcagatgaccagcccccgcacaggcacgggggtgcctccttccccgcacaggcacggggggcccgagcccttggggttcctgtcctaactgggcggggaaagggagggttggaagctgagttagggggaaagggggtggtctcctgccatctcttttattttatttttcctatttttggttgataggtttcaatcttttttacatttttccaactttttgccgtaaaacttttcaaacatagaaaagatgaaagagggctgagtgtggtggctcatgactgtaatcccagcactttgggaggttgaggtaggaggatcacttgagcccaggagttcaagaccagcccgggcaatatagtgagatcccatctctataaaggatacaaaaaattagtcaggcatggtggtgcaggcttggagtcccagctactcggaaggttgaggtgagaggattgcttgaacctgggaggttgaggctgcagtgagctgggattgtgccaatgcactccagcctgggcgacagaacaaaaccctgtctcaaaaacaaaacaaaacaaaaccacaaaaaagaaaccatgaaagattctaaagtaaacacccatgcacctaccacctagattccacagcaaccattttgctgtttgcttcaccacaaatccctctggccaccagcatccacgctggttttgatgcacttaaaataagctgcagaaatcagcacacaacatcctgtcaacacctcagtttgcatttcattaactagagtccggcatttgtctgtgattatttttgtttttctttgaagtaaaatgtatataccctgagatgcacaggtgtgaaacgttccgttctttgaattttaacaaaggtatccacgtgtatcccagcctgaccagaacatagaacatcactatcaccccagtaagttcctcatgcccctccaggtgcatcacagtccccaccttccccagggcaaccacaattgtgctttttttccaccacgaaataattttgccagtttgagtgtttcttagagctacccatgttgctgcaggtgccagcgatttgttctgttttattgctgagtaacgtccactgtgtgaacattctgtgggtttttagtcattctcttgttgaaagacccctggctgtttccatctggaggctcttatgagtaaacctgttacgctggttcttcttgtacaagtttttctgtgcatatgggcgttcatttattctgtagaaacacctagagtaggtatagggtaggtatacatttagttttataagaaactgccagatcttttcccaaagtggcccttccatttcacactcccaccagcaatggatacgagttctagttgctccacatcctggccaacatttggtgctgtcactctgtgaaatcttagtcattctggtgggcgtgtagtggtatcatctcattatggctttaatttgctttggcctgatgactaatgcggttgagcacattttcatgattggctcttcatatatttttcctttgtgaaatgtcttttcaaatctgttgctcattttaaaattgggttgcttgactttttcttctggatactgatcttttgtcagatacgtgttttacaaatattttattccagtctgtggcttgcctgttcattttctttcctttttcaagaacaaggtctcgctgtattgcccaagcaggtctgaaactcctgggctcaagctgtcctcctgcctctgcctccccaagagccggttttacaggcatgagccaccatgcccggcctgttcattttcttagtggtattttccaataagcaaaagtgtgtcactttaatttttatgaagtctaatttaacaaactcctttctttgtggttctctctctgtgttctttgtaagaaacctttgcctaccctgccaaattgcaaagatatttatgttttcctttagaaggcttagagttatatagcttttatgaattaacttttgcatatggtgtgaggtagagggtcagggttcattttgttgtcgttttatgtgtttattcagttgttccaaacttcatttttttttaaagcttttattttgtattttcttggtgacttatgaggtcgcacaattttccaagatccttgttggtcatttacgtattttcctttgtaaaattatctgtccacgtcttacttctttttaaaattatgttgtttcaagatcgagtgatttctgaagccttcattttataatgcttgaaagaatgaacaccttgttccccagctacaggcttctgctctttgtcctgcagctgcacagtggggtaagacttgggttttgttttgttgctgctttgttgtttcttcatttgactgtttccccatgggtctcatttaaaaaaaaaattggccgggcacagtggctcacgcctgtaatcccagcactttgggaggccgaggcgggcagatcacgaggtcaggagatcaagaccatcctggctaacacggtgaaaccccatctctactaaaaatacaaaaaattagccgggcgtggtggcgggcgcctgtagtcccagataatcgggaggccgaggcaggaaaatggtgtgaacctgggaggcggagcttgcagtgagccgagattgcaccactgcactccagcctaggtgacagagcaagactctgtctcaaaaaaaaaaaaaaaaaaaaatgttgtttcatatgttttttatatattctggatataagtcctttatcagatatatgtatcataagtttttttttccacattgctcctttccttttggttttcttaatgatgttatttaatgagcaagagtattttgttttcataaagtccaatttatcaactttttccagtttcgatttatgatttttgtgacctatggaggaaatctttgcctacactaaggtcaaaagaagttctcttattttctagaaattttatagttgtatattctatgattccttttattttttaattttttaaatttttacattttttaacctattatagccgtcaggatgttgtatgatccattttaaatcagtttttgtatttggtttgaggtcagggttaattcttgtttttctatactcatatccagttctagcaccgtttgttgaaaagacataccttactctattgaattacctgacacctttgctaaaaatcattgactgtatatgtggccctatattagtatatgtacgtatatacatgtaggccctgtgttgactgtatgtgtggtcctatattagtatatgtacgtatatacatattggccctatgttgactgtatatgtggtcctgtattagtatatacatatcagccctatattgactgtatatgtggtcctgtattagtatatgtacatatatacatgtaggccctatgttgactgtatatgtggtcctatattagtatatgtacatttatacatgtaggccctgtgttgactgtatatgtggtcctgtattagtatatgtacatatatacatataggccccgtgttgactgtatatgtggtcctgtattagtatatgtacatatatacatgtaggccccatgttgactgtatatgtggtcctgtattagtatatgtacatatatacatataggccccgtgttgactgtatatgtggtcctgtattagtatatgtacatatatacatgtaggccccatgttgactgtatatgtggtcttgtattagtatatgtacatatatacatgtaggccctatgttgactgtatatgtagtcctatattagtatatgtacatatatacatgtaggccctatgttgactgtatatgtagtcctatattagtatatgtacatatatacatgtaggccccatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatatatatgtggtcctgtattagtatatgtacatatatacatgtaggccccgtgttgactgtatatgtggtcctgtattagtatatgtacatatatacatgtaggtcctatgttgactgtatatgtggtcctatattagtatatgtactgtatacatgtaggtcctatgttgactgtatatgtggtcctatattagtatatgtactgtatacatgtaggccctgtgttgagacactattgtgttttcttgatattttgtccattcctttgctgatgccacatcttgattaatgtggctttacagtaagtcttaatataaagtctctcaaatatctaaaatattactttgaatattctaggtcctttgagtttccttataaatttaagaagtagcttgttgatgtctacaaaaatgcagtgtgaattttggttgagattgtgttgaatctgtagatcaattaaggaagaattggcattttaacaatattgagtcttttgtatagatggtatatctccgttttaaaggtccttttgtatttcttttatttctctactgaaaaaaaatctctacagaattacattgttttgtagttttcaagaaaaagatcttgcatgccatttgttaaatttattcctaagaattttacttttggcactattttaagctgaaatagattttaaatttcatttttaattatttgctgctagtatgtaaaaatacaatagatttttgtatgtaaatcttatatcctatgatcttttccaaagtcatttattactctggtaatggttttgtaggtcttttaggatttaaatacatagttttacttctttctgatcttgatgccttgtttttttttcttgctttattgcactggttagagctgccagttcagtattgaatagtagtgattagtggacatccttgcctgtgccaaacttataatgttaactttagatttgtcatatatgacctttgtcagattgaggaaattcccttctattcttaatttgctgaaattttttaacatgaatgggtatgattttagtaaatgctttttctgcatctatggaaatgatcattgttttgtcttttattcgtttaataggataaattacaatgattgatttttgccccccgttttttttttttttttttttaaagaaacagagtctcactcttgcccaggctgtagcacagtggtgccatcgtagctcactgcagcctgaactcctggacttaagcaatcctcccacctcagcctcctaagtagcagggactataggcacatgccaccatgccaagctaatttttaatttttaaaattttttgtacagatggggtctcattgtgttgctcaggctggtctgcaattcttgagcttaagcaatactcccacctctgcctcccaaagtgctgagattacaggtgtgagccactgtgcaggcctgattttttaatattgaaccaaccttgcatttctggaagaagtccaacttgcttatgagatatcatcctttttatatattgctaaatttgatttgcccagtttttaaggatttttgcgtgttgattcatgagggatattggtgtggtattttctttgtttgttagtttgtttcggtaatgtctttgtcagcctcattttggcttcataaaattagtttggaagtgttcccttctctttgttttctgtgttttcataaggttgatgttgtttcttccttaaatgtttgatagaatccaccaagaaaaccgtctggacctagaattttctactaggaaaggtgattgtttgtttttaatcacaaattcaatttaatgtatagaaagagttattcaggtttttttacttccccttgtcttacttttggtaagttgtactttgaaggaatttgtccctttcaggtaagttgttgaatttactcatttaaagttgttcgtaatacaagcatacctagggtttgcttccagacctcggcaataaagcaaatattgcaataaagcacgtcacacaaactttttggtttcccagtacatataaaagttatgtttaggccaggcatggtggctcatgcctgtaatcctagccctttgggaggccaaggtgggcggatcatttgaggttaggagtttgagaacagcctggccaacatggtgaaacctcatctctattagaaatacaaaaattagctgggtgtggtggcacatgcctgtagtcccagctgcttgggaggctgaggtgggagaattgctcgaacctgggaggtggaggttgcggtgagctgagatcacaccactgtactccagactgggtgacagggcgagactccatctcaaaaaaaaaagaaaaaagttatgtttacactatactatagtctattaaagtgtataagatcattatgtctttttgctaaaaaatgctaataatcatctgagccttcagcaagccataatctttttcttggtagaaggtctgcctcaatgttgatggctgctgaccaggtggtggttgctgaaagttgaaggtagctgtggcagcagtttctttgtttcttttttctttttctttttttttgagacagagtcttgctctattgcccaggctggagtgcagtggcacgatttcagctcactgcaacctctgcctcccgggttcaagcaattctcctgcctcagcctcccgagtagctgggactacaggtgcctgccaccacgcctggctaatttttgtatttttagtagagacagggtttcaccttgttggccaggctggtctcaaactcctgacctcaggtgatccacctgccttggcctcccaaagtgctgggattacaggcgtgagccactgcacctggccggcagtttcttaactgaagtttttgacatgggttgactctttctttcatgaaagatttttctgtggcacgcattatgtttgatagcatcttacccacaatagagcttccttcaaaattagagtcaattctttcaaccctggccacggattgatcaaataagttgatgtaatattctaaatcttttgttgtcatttcaacaatgttcacagcatcttcgcctggagtagatcccatctccaggaaccactttgtctgctcatccataagaagcaactcctcatctgttcaagtttgatcatgggattgcagcaatccagtcccatctccaggctccacttctaattctagttctctgctatttccaccacatctgcagtgacttcctctgctgaagtcttaaaccgctcatccatgagggttggaatcaacttcttccaaactcctgttaatgttgatatttcaacctcttcttgtgaatcacaagtgttcttaatggcatctagaatggggaatcctttccagaaggttttcaatttactttgcccagatccattagaggaatcactaactatggcagatactgctttataaaatatatttcttaaataataagacttgaaaatcaaatttatcccttctccatgggctgcagaatgggtgttacattagcaggcatgaaaacaacattcatctttacatacatctccgtcagagctcttgggtcacaaggtgcattgtcaatgagcaataatattttgaaaggattcttttttcctgagcagtaggtctcaatgatttttttttttttttgatggagtctcgctgtgtcacccagaatggaatgcggtggcatgatctcggctcattgtaacctctgcctcccgggttcaagtgattcttgtgcctcagcctcctgagtagttgggattacaggcacacaccaccatgcttggctagtttttgtattttttgtagaaacagggtttcaccatgttggccaggctggtctcgaactcctgacctcaggtgatccacctgcctcagcctctcaaagcattgggactacaggcatgagccactgcaccgggccctatttgttttttttttgttgttgttttttaattgagacagagtctcgctttgttgcctagactggagtgcagcagcgctatctcagctcaccgcagcctccgcctcccaggttcaagtgattctcctgcctcagcctcctgagtagctgggactgcaggtgtgcactaccatgcctggctaatttttgtatttttaatagagatgaggtttcaccaccatgttggccaggctggtcttgaactcctgaactcaggtgatttgcctgccttggcctcccaaaatgctgggattacagctgtgagccaccgtgcttggcccttttttgtttttttgttttttttcaaattgagacagagtctccctctgttgcccaggctggagtacagtggcacgatctcggctcactgcaacctccgcctcctgggctcaagcggttctcctgcctcagcctcccaagtagctggaattacaggcgtgtgacaccatgcctgaataatttttgtatttttagtagagatgcggtttcaccatgttggccaggctggtctcgaactcctgacctcaagtgatccccccgccccagccttcaaaagtgctgggattacaggcgtgagttgccgcaccaggcctcaatgggtttttaatattcagtaaaccatgctgtaaacagatgtgctgtcaagtagggcctgttattccatttctgaagcatagacagaatagatttggcagaattcttaagggccctaggatttttggaacggtcaatgagtattggctttaacttacggtcaacagctgcgttagcctctcatgagagtcagcctgtcctttgaagctttaaagacaggcattgacttctcccctctagctatgaaaatcctagatgacatcttcttccagtagaaggtgggacatctatgctgaaattctgttgcttagtgtagccaccttcatcagtgctctgagctagatcttctgggtaacttgctgccgcttctccatcagcacctgctgcttcaccttgcacttttacattatagagatggcttctttccttaaacttcatgacctgacctctgctagcctcaaactttccttctccagcttcctcacttctcttagccttcataccattgaagagagttagggctttgccctggattaggcttttgtttaagggaatgttgtggctgatttgatcttctatccagaccactcaaactttcttcatatcagcattaaggctgttttgctttcttcttcttcatgtgtgcactggaatcgcacttttaatttctttcaataactttttcttggcattcacaacttggctagctatttggcataagagatctcacttttgcctgtcttggctttcgacacgccttcctcactcagcttaatcatttctagcttttgatttaaagtgagagacgggtgactcttcctttcacttgaacacttagaggccattgtagggttattaattggcctaatttcaatattgttgagtctcagggaatagggatgcctgagcagagggagagagagcggggaacagccagtcagtggagcagtcagaacatacaacgtttattgaataagttcactgtcttatctggatgtggctcgtcatgccccaaaaacaactgcaataatggcattgaagatcactgatcactgggcgcggtggcccatgcctgtaatcccagcactttgggaggccgaggcaggtggatcacctgaggtcaggagtttgagaccagcctggccaacatggtgaaacctcgtctctactaaaaataccaaaattagccaggcgtggtggcgggtgcctgtagtcccagctactggggaagctggggcagaagagtcgcttgaacctgggaggtggaggttgcagtgagccgagatcacaccactgcactccactgcactccagcctgggcaacagagcgagactccatctcaaaaaaaaaaaaaaagggccgggcgcagtggctcacgcctgtaatcccagcactttgggaggccgaggcgggcagatcatgaggtcaggggattgagaccatcctggctaacacgatgaaaccccgtctctactaaagatacgaaaaaaatagccgggcgtggtggtgggtgcctgtagtcccagctactcgggaggctgaggcaggagaatggcgtgaacccgggaggcggagcttgcagtgagccgagatcgcgccgctgcactccagacagagcaagactctgtctcaaaaaaaaaaaaacaaagaaagaaaaaagaaaaaagagatcacagatcaccatagcagatataataataatgaaaaagtttgaactatttcaagaatcatcaaactcctacacagagacacagtgttaacatgttgttggaaaaatggtgccagcagacttacttgatgcagggctgccacgaaccttcaatttgtaaaaagtgcagtatctgtgaagcacaatgaaatgaggtgtgcctgtgttccttgtcactgtaatgtcggtaggatccgtaaggaaaacacttcattccttttattgtgactttatgttcgccatctccctctcatcagcagcctggctaggaggttatcaatctagatctttttaaagaaccagcattggactccccttttctggtgtccatttccttgagtttctctgttatcttcattacttccttccttgtacttgcttcagcgcattagtcagggcccagtcaggaaacaaaaaccacaccggcaatttgaatagcaacttgtaatataaagtgttcttaactgtaagaggtagttaactattaaagggatcacaaaggggtgacattgtgatataagaaagatgtatttgggctgggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgaggtgagaggatagtttgagcccgggaaggcagacgttgtggtgagccgagattgcactactgcactccagcctggatgacagagggagactctgtctcaaaaatcaatgtatctgtctgtctgtctgtctatctatctatctatctatctatctatctatctatctagtctctgtcccccaactttgtttggcatgtagctcctaaaactcttgaaatctccaaagtgatgggtgtctttttgtttgctaaggaggcgactggtggctggaggctcctggacagcctggggataagggctggttgccaggggacccagccttgtgattagaaggctagaacttgcagcctttcccatccacctcctgcgaggcaagaggggatgaaggttgagttgatcatcaatggccaaagatttcatgtcatgcttatgtagtgaagcctccctgaaaacccaaaaggatgaggtttgtagagtttcaggttgttgaatacctgcaggtgctgggagggcagtgtaccctcccgtggaagctccatgccgcttccttcatacctttcttatgcatctcttccagttggctgttcatttgtatcctttgaaatatcatttgtaataagtcagcaattttaagtaaactgatttcctgggttctgtgagtcactcaagcaaattattgaacctgagaagggagttgtgaagacctcaaatttgtagccaagtcagacagaagttatgggtaacctggtgtcttaccacttgcgactgatctctgaagttgagggcagtcttgtgagatggaacccttaacctatgggatctgcactaactctggttggtgtcagaattgaactgaattgcaggacacccagttggggactgctgagtattggagaattgcttgggggtcggcgggaggaaaccacacatctggtgtcagagctgaagcactgagtgttgtgaatgagagtggagagatagagtttgttttgccttatgcaagaggactctaaggagtatagaaagagcaaatatgagaagcagctactttagaagaaaacataggaggaaagcttcgtgacattggagttggcaatgctttcttggatgtgacaccgaaaatacaacaaaagaaataaatgataaattggacttcaccaaaacttaaaacttttgtgcatcaaggaatactaccaatggcgtgaaaaggaaatccacagaatggaagaaagtatttgaaaatcgtatatccgataaaggactagtatccagaatatataaagaactcctacaactaagccacaaaacaaaaaaaaacaacccagtgaacagacatttttccacagaagacataccaatggccaagaagcacaggaagagatgcgcagtgtcactaatcatcagggaaatgaaaatcaaagccacaataaaatatgatttcacaccctttaaggtggctgttagccaaaacatggataacagcaagtgttggcaaggatatggagaaattggagccccgtgcactgctggtgggaatgtaaaatggtgcagctgctgtggaaaagatataacaattgctcaaaaaattaaactcagaatgaccataacatccagtgattccacttctagatgtatactccaaagaactgacagcagggacttgaacaggtgtgctacattcttgtttgtagcagcacttttcccataaccaaaagatgcaggcaacccaggtgtccaccagcggatgaatgaacagacaaaatgtggtccatctgtacagtggaatattattctgccttaaaaaggaaggagaggccaggtgtggtggctcacgcctgtaatcccagcgctttggaaggccgaggtgggcagatcacttgaggtcaggagtttgagactagcctggccagcatggcgaaaccctgtctctgctaaaaatacaaaaattagccaggcatgggggcatgtgcctgtaatcccagctactagggaggctgaggcaggagaatcgcttgaactagggaggtggaggttgcagtgagccgagaccatgccactgcactccagcttgggcgacagagcaagactgcctcaaaaaaaaaaaaaaaaaaaaaaaaaaaggagattctgacacatgctatagcatagatgagccttgaagacatgctaagtgacagaagccagacatgaaaagacaaatactgtatgatttcacttttatgaggtccctagagtagtcaaattcagagagacagaaagtgggatggaggttgccagaggctgggggaagggagaatgaatgggaagttggtgtttaatggggatagaattgcagtttgggaagatgagatggatggtggtgatggttacacaacagtgtgaatgtgcttcatgccaccaaactgcacacctgaaaatggttaaaatggtaaattttctgtgatggatactttaaggcatgtatgcaaacacacagaagcagttactaccactggggttgatggaaaagaaaccaagaactcggagcgtcctccacaccttgccacgtcttacgttcaggccttgttggagagtgtgtgactgccacagaaacctgcagcctactggtaacaaaaaggttcttgccagaaggtgtagaaagagtggatctgcaggatcagcttactgggtagccgagaaacctactagagggtatgggtgggcaggagctgggtgtctgagaagtttgctgaggtcccattgggctagagctggggtgctggagaaactcagtacagagcaggccccactgggcacacgccactggcagctgtgccttcagaggaaaaagagaccctggaaccaggaagagaagctgctacctcagcaaggcctggcagctccccacagtgttgtcccctgtggatagagcctgacatgactgtatttggccaaggagaaagactcataaggcctcggtccagtatcacggagcggggcctggcaggatgtatgcagagttaagaggcaatacatgggtaactggcatatttttccagattctttgttttttttgttgttttgttttgttttgttttgttttgttttgttttgagagagcatcctgctctgttgcccaggctggagtgcagtggcatgatctaggctcactgcaacctccacctcccgggttcaagccattctcctgcctcagccttctaagtagctggagatgcccaccatgcccagctaatttttgtatttttagtagagacagggtttcaccatgttggccaggctggtcttgaactcctgatctcaggtgatccacctgccttggcctcccaaagtgctgggattacaggcgtgagctacactgcacctggcccatttttccagattcttaaagcagatccttaggtctttttttttttttttttttttttttttttacttcttttctaatataagcacttacagtttccctctaagcactagcttcagcctacgtattttagtatgctgtgttttcattatcatttcatttgaaatattgtaaaatttttcttgtgatttcctctttgactcatgggttatttagaagtatgttgtttaatttgcaaatagtcaaggctcctctgagtatcttagagctattgatttctaatttaatcttactttggccagacaagcatattttgcatgcttttaaaatttgagacttatggcccagaatgtgtatcttggtgaatgcactgttttcacttgagaaaaaaatatgtatatatattctagacttcctgagtatagagctttataactgctgattaggtcaattgctagttaccagtgttcttcagattatctgatgcttgtttctcagatgttgagagaatggtgtttgctatggcctacctgtttgtgtcccccaaaattcatatgttggagcttaatctctggtgcagtggtgttgggaattggggcatcagggaagtattggctcatgagggcagagtcatcgtgaatgggattagtcccttctgccatgtggggacacagcaggaaaaggacatctctgaagcagggagctagctctcaccagacactgagcaccctgattttggacttcccagcctctagaactgtgagcactacaatctgtttataaattacccagcctaaggcattttgttttaacatcctgaatgaactgaggtggtgttaaaatctccaactatgcatccaggcgcagtggctcacacctgtaatcccagcacttcaggaggccaaggcgggtggatcacctgaggtcaggagtttgagaccagcctggacaacatggtgaaaccttgtctctactaaaaatacaaaaattagctgggcgtggtggcaggctcctgtaatcccagctactcgggaggctgaggcaggagaatcgcttgaacccaggaggtggaggttgcagtgagccgagattgcaccattgtactccagcctgggcaacaagagtgaaactccgtctcaaaaaaaaaaaaaaagagtctccacctatgattgtggaattgcccatttctccctttaattctttcaggttttatatcatgtattttgaagctcctttggttaggtgcatacacatttatgattataatggtgtctcgatgaactgatcatttaaccatgatgaatgtattcctttatctcgtaataattttatcttggactcaactttattgatatttatgtagcctctccagccttcttaaacatgctgtttgggatgcataagaaggctggagaggcttatggagaaacttatgatggtttgacttacagtttttcaactttaccatggtgcgaacgtggtatgtatacagtagaaactgtactttaagtatgtgtgaaaccattgtgtttctcactttcagtacagtattcaataacttacatgagatagtcaacactttattataaaataggctttgtgtttgttgattttgctcaactgtaggctgaagtaagtgttctaatcatgttaaggtaggctaggctaagctagaatgttcggtaagttagatgtattaagtgcatttttgagatgatatttattttccacttatgatgggtttgtcaagacataactccatcatcattcaagcagcatcagtatgtctttttccaaacagaaaatttcaacctgtgtttatactgaaacagcatcttttgtagatagtatatagttgagtcttgctattttattcattctgacagcctccgccttttaattggaatattcaggctatttctgtttaacatagttatagatatgactgggtttagagctactaccttgctctttgatatttatttctttcatcttgctttcttggcttcttttatgttaattaagtattttttagaattctattttaatttatgttttttttttttttttttttttaagacagagtctcactctgttgcccaggctggagtgcaatagcatgatcttggctcactgcaacctctgcctcctgggttcaagtgattctcctgcctcagcttccctagtatactgggattacagacgcctgccaccacggccggctaatttttgtatttttagtaaagacggggtttcaccatgctggccaggctggcctcgaactcctgacctcaggcgatccgcccaccctggcctcccaaagtgctgggattacaagcgtgagccactgagcccggcctgttttgactttttaattgtatctctttgtattgctattttagtagttactttatagattctattgcacattcttagcttttcacagtctacttagaattaacattgtttttcttcatggaaaaaaagtgtaagaactaggcaatcctatgggttcatttaccactttccatcctgtatgtgatggttgttagatatttactacatccatacacattgtaaactagacaatacaataaggaaatttttgctttaaacagccccatgcattttaaagaaattaaaagtaaaacagaatcttttctatttgcccatgtatttgctatatcctgtgctcttcattccttcctgaagagctgagttcccatctggtctcatttcccatgatcttggagaacttgcttcacggtttttgtagtgcaggtttgcagacagctaattccctttcattttcacttatctgcaaatctttattttgctgtcattctttctttttttatttttatttttatttttgagacagagtctcactctgtctccccacaggctacagtgcaatggtgtgatttcaaaactcctgcccaatctcaactcaccaaccttctcctcccgggctcaaacgattctcctgcctcagcctcccaagtagctgggactacaggcatgtgccatcatacccagctaatttttgtatttttagtagagatgggatttcaccatgatggccaggctggtctcgaactcctgacctcaagtgatctgcctgctttggcctcctaaaatgctgggattataggtgtgagccactgtgcccagcctgctgtcattcttgaaccataatttcactggttatagaattctgagttgtcagttttttctttcaggactttaaaatatagggttccagtgtctttggcctccgttgtttctgtcaaggaatcagcattcatctagctattcccctgtagaccacatgttgtttttccctggatgcttttaagactttttatccaagtttgattgctcagtacctacctctgggcaaaaaagcctccagaaaccagaaacttatctagttttattcccctctgtcaggtgtagactctactccagcttctacctacttgagatattctatactgactccaggctgttgttattttgttctttcaaatattttgtccagagctataatgttttctgcagaattgaccagatagcagctactctctgtgaccaggagccttgatcttccagacttgctgatgggctcacaaagctcctgcccgtggccctcagttggcagtggcctctctgccttgaagttgccatgagtgtgtaaaacctacaggctcaaccttcctcattagtacagtccagaaaagtggaattcctggtctgggtggctatggtgccctagaccactggctagaccagggtggtgactgccagctggccgaatgtggggtctccagcctagcacccttggactctaccccaggagttatggctgtttcagggccaggggcctggcctcagcccctgtcccccttctcttctcctcaagttgcccagcatcaggtcccaaccagcatcttttgcagacagggtgggtcggctcctcactagaggggcagggttgggcgggaagcctgttgagccctccttcctgtgcagcccacagccctggggttagctccagaggggtgcagaaaggagcccccaaaggcagaaactcacccttctctctgttcttgtgcttccagggataaaggagaggtggtcctagctggggggctaccagtggcatgcaggaggcccacatgaccactgtttgctggggcctttccttctctgtgagagagacgagagagaggagagagagtgtgagtcagggtagtgtcttcttccagtaacgcagacttctgcacgtgttctctaggagaaatcccgtcactcgctagagctctagatctggaagaagctctgcctctcttctctcctccagtgcagtgtgtgtgtgtgtgtgtgtgtgtgtgtccccacatgcattacacccttctacagaggaaataattcccgtccaagtgcaaaggttgggattggagcaggcagcatgtgggctaaaggagcagagaggaggaaacgggggcgggggtgagggtgggaacaggaggtgggtagatgccacgaggcatgccttccacaactagaagggctggtggagatgaccagaatgctccagacagaccttttatcaaacttccaaaattcaatcttgtttcatgaagcctgaggaccctgcagagtgaaagacaaggaagggctttcctgcaggggggtgtgtgtgcctgtgtgtgcctgtgtgctgtgtgcccccatgtgtgtgcacgtgtggacctgtgtggtgtgtgcctgcacatgtgtgcacgtgtggacctgtgtggtgtgtgctgagtgtgtatatgtgtgtgcctgtgtgctgtgtatgcacttgcacatgtgtacacagatctcattttccttttttctggcttactaagtgccagaaagaatttccgtgagcctctccacccttcccaaggctgcacatggagggacttgcgcaggcacatgtgcgcgtgcacacaacacacacacacacacacacacacacacacacacacacacacgagtcaggggcgagcactcctgtggattgtacctaggcctggcaggaaaccgggttctgggaaactgtaggccccacctttggcagaaaaccatgtttttgttgctgctcgttgaagggaacattaagtggggctggggacagtttatgttgagaagagcaaattttgcctatggcactggggacattgagtggctcctgtcccgggctctggagggcttgggagacacgtctgcagctctgggcatctctcaaggtcacgggcggccacactcaaggttaggccctcctctgtgtgagctgcggtcagcaggaaggctgacctcagaggcggccccagggcccttggaggccctgcccctgagacatgggccaaggtcagagagccgagaaggctgctgctgaggactctggttggcgcccagcccagcggcccttcaggcgggccctgtgcaggggctgatgaagtcagctgggaaatctgtgaaataaagcacaggtcccccaggcttgcccagagccccggcatcagatgaggtgcagagaagggaactgagctgccaagtgtgaacaggagagaggagccccaggaccacacaggggccccgacatggcaggtgcttggtcagcagcggtgctgcccttactgctggacgtgggaaaatgcactgacacttgctgaccagagccggggtgagcatctgggtgaccctgcagatgagacaaaataagggctgccgtgggggaggggcccttgccgggccaccctgctgaggccctgtgttactgtcctgcggctgtcataacaaaggaccacaaatgaggtgactcaaaacatccgaaatcggccacgtgcggtggctcatgcctgtaatcccagcactttgggaggccgaggcggttggatcacgaggtcaggagatcgagaccatcctggctaacatggtgaaaccccgtctctactaaaaatacaaaaaaaaaaaaaaaattagccgggcgtggtggtgggtgcctgtagtcccagctgctcaggaggctgaggcaggagaatggcatgaaccttggaggtggaggttgcagtgagccgagatcgcgccattgcactccagcctgggtgacagagcaagactccgtctcaaaaacaaaaacaaaaacaaaaacaaaaacatccgaaatgtcttccctaaagtttctggagccagaaatcccagaccgaggtgtctgaaggttcattcctcctgggggttccgagggagactgtcccatgcctttctccgagctctgcggcggccagcaacccctggtattcctcggcttgcagctcggcctaccccccacctggccttcaccctgtgtctcttcttgtgtctctgtccaaactgccctctctgttgtctttttaatttatttttagggacaggttctcattctgtcctccaggctggagtgcagtggcgtgatcatggctcactgcagcctcagcctcccaggctcaagcaatcctcccacctcagccttccaagtagctgggacacaggcgcacgccaccatgcctggctaattttttaatttttttgtagagacgagggcccaggctggtctcaaactcctgcgctcaggcaatgagactttgcctcccaaaacactgggattagagacatgagctgctgtgcccagcctacctctgtcttataaagacacctgtcattggatttagggcccactctgattcaatatgccctcaaataacccaattacatcttcaaagaccctatgtccatataaagtcacattcataggtactggggggtcaggacttgcatatgtcttttgggggaacacaattcaacccacaatgggtctcacccacagaacgaacggcctctccagggtgtgcgcaggtgggtgaggggcccaggagagggacctgcgtggcaagagggcttgtgttcacgtcagagattccagaaggagactggatggggtggctgcatggagcaaggggctacagccactgtctccaagtagttggtgggttgtctggtagaaagggagcatttattttgagttcccccaagatatgaagctagtaccaggtacctggaaggtgctagcgagtagagcttgactctttacagaaagaggtgtttttctcacaatgttcacttgaggacggtggaacaggctatttcacaaggtagtgagttccccatgcctggaagcattcaagcaggggccatgtgggagttgttcaggagtgcatagaagggacctcagaggtccctgccaataccatctttgcttgtcttattttacgacaacttgaatttcagaatgtaatgttattggggatatgtctactagaggggcctccagcatcaggccccacacactatgcatcatttttagggcagggaatgagagcaggctccattctttttggttgtctgtgaggaccaggaggcttgctgctgaggcagcttcctgtggaaacagtgtctcagccccgcaatccattcatcggagctccaacatcttaatgaaacactgtgtcagatgggttctgggcatgtgtgtgcagattgtcacaagtccatgagaatgcacacacgcacattgcatgtgtgtgcacacatgtatgcacacatgcacaagaacacgaagacccgaggcaggtatagtccgtgagacagatccctctaggctgaaagactccccacaagggtccctagaacaaggctccagcctcggcagtccctcccacttctggtgggaggatctccacagagaagaagggtcaagaagcacagctcttgatgctcacggtgtaccaagctctgctttaagcttgtgtcttattttttacttatttagcaaatctgtcgctcttgttttgtgccagatgctgttctcagcactttacaaatattgatgcatgtttgtttcatgacaaccctgtgaagtaggtagtgttaccccgttttatagatgaggaaacaggcgtagagggataaagggacttgcccaaggtctgtctctaccttacacgcacatgaacgctcactcatgcggcaggcgctagtttccctctgatgtgagtcaggccttgagctggttggggtctgggtcccactttggttgtgttttgctgtgggcaccaaggaagcttctagcagcctcatctccctggtatgacctagctccagggactggatttccccaaatgctcctgcccagcctggagcctcctttccagctgggggagggctgaacgacccctcactcttggaggctgccggagcccctcctgcctgcatgcggccgctgccgggtggacaggcctgcttgtgggttgaggctcccagcagctggggtggatcatttctcctcccaagaagctttgggagaagcagctgagggggccagcgtcctcctgaggccaattccctgcctcccccagcgcaggcgcgaagccatctttgcttgtgtgtttgccacagacagtggagggcggtgcaatcgtgacgcctgcttgttgcactttgcgtccttgaggacgttgacccctggccggtgctgggcgcttgctcttcagtcatcttgccctgacctggcgtggcaggcccgagcactgctcttttacaaggaaacaggctcagaggccttgagtcacttgcccgggctcccccagccaataattggctgagccaggatttccatccagctctgtgactccagaagtccaagttcttcccatcacgtcagggccaggaaaggattagaatgcttttctacgtgccgattatttggatgatctgtgcagcttagctcgttgtagttgctcaataaaaatgtggaatgaatgggcctatatgtcccattgtgtgactcagagccaatgactctggctgatcctcctgttttcattccgtggcccagcatctccctttggggtgtgtgaccttggaagcagtgactctctccatcccaccttgaatggtgtctgcgccgcagcaggggagcagctggggattgccagcgcctgttgctggtgggctgtgcgccagatcccgtcttggatgtgtgggtgattgtcagccacatgtgtgtgaagggctgtgcgtgtaggatttgtgcaaatgtgcccctccctgctgccagcccatgggaggctgtcaagattctgcccctgcacattagcccacactctctttgtggcccactgctgtggctgttcccttgtgtcacgtggctgcaggcacagcccccaagtggatggggatcgtgggctgaatgtgcatcagatgctcctgcttcttggtgggtggagaccctcaacccatgcaccgtggctgccgcatctgaaaggccttccatggtgaaggacttggacctgagcaaccctccgcagaggtcttagaagtgctccctggccgggcgcggtggctcacacctgtaatcccagcactttgggaggccgaggtgggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccaggaggcggagcttgcagtgagccgagatcgcgtcactgcactccagcctgggcgacagagcgagactccgtctcaaaaaaaaaaaaaaaatgaagtgctcccagctcttcctcctgtggtgaggttctgagtttccatcctcagaagaaaacctggctggggagggcatctctagacccggacataaacgccaggagaccagggctgccctctcaggtgaccaatcacagagactcagggaaagtcacgtttggaagaggcgacactgtgtctcagcctcattcatttctccatcctacagacactgcctggtgcccagcccgcaccgcgaggcttcctaagcagctctgggcaccgtgcacctggcatggcctccagccccatctccctgccttgggagacccggtggggactccgggctgagctcctgtggctgtggaaccttggtggtttattgtggtggctgagaacagggacgtggggttggacgggttgagtgtaactcccagtggctccgtgaactgcctgggagccttgggcagctctttctcactctgtgcctccgcttcctgatggaaaaatgggggccaggggggagcgaccttgaaggtattcgtgggaaccaagcgaggtgataaatgtagtgtccttggtagagaactggacacagagtccacccccatgaagggggctgctcctcctccttctatgtttcctcttgttcttatttctcctcttgtatcttctcttcctgctttccctccccctcccctccccccccacatgcaggcacactccatttggtgccccaactgcctttctccattgtccttctgtaagtggttctctaagtgggaactcaggcctggaaagggtgggcaccctgtctggtgggctctggcaggccaggcgctgagcagcctcaggagacacaaccctaggaaaaggctcatgcaggctggctgtcatgacggactgttggtgggagaggggaaggcgccgtggtaggggaagctttggaaacatccactagtggccttatttatgactcaggacacctgccaggtcactagaacacagctgaggaagctgtcggccagacgtccagaagcatcaacctggtggctgggctgtggggggacctctctggacaggcagacaaggtgtcggaggaaggggctgacactcactcagtgtctgtcatgcactgagggcacaaagggcaggatggagagctggcccacgccacctgtggaatcttccaggtgtgggggcagatggggaagcaagggggcttgaagacacatgcgctcattaaatgtccttaaatcccaagaagaagaacaaggacacatccacaggggcagggctgaaagtctgatgcatggtgttttggggtctgctcctgctgcaacagctacagtggctccctcttacctttctcttccctccattctgttgtgaaaatgttcaaaacacatggtcaagttgaaagcattttacagggaacacattcagccatcacctagattctaccactaacaccaagctacacctgctttatcacctcaccgtccatctatccctccttcgcctggccatgaatccattttatttttattttttggtgcatttcaaagtaatttcaggtcatcctgattatctctggaatcactgtcagaaattccctcccttcccctcccctctcctttcctttccttttctgagatgggatcttgctaggtcacctaggctgaagtgcggtggtgcagtcatagcacactgcagcctccaactcccgagctcaagcaatcctcctgcctcagcctcctgagtagctgggaccgcaggcatccaccaccacacccagcttcattttcaaaatttctcaccaactcctcactccttgtattcacccaggaccacttctcacaaagccagggtgctgcaggaggggtcagaaccccaagccctaatcctggctctgtcattaacactgtgcgaccctcagcaaatcattttgcctgtctaggtcctgttttcattcctatgaaacgagggcgttaaactgtatgttataaataatgagggctaccagttaccaagctcctattttaggccaggcacttttcacatgttattatgagtcctttcaatctaggtattgttctcaatggacagcttagtcaacggaagctcagagaggtggtgtaacttgccaaaagtcccactacccagtgaatgtccccacggggtctgcacccaggagtctgacacagagcccaggcctcagcacctggcgatgttttgggggtgtgagcagcccagcctactctgggcacgtgtttacttgctgttccttctgcctcatgtttgtgtttgtcccctctgaagctcagactgttattttccagttccaaataccaaaactggctaggcacggtggctcatgcctgtaatcccagcactttgggagaccaaggcgggtggatcacttgaagtcaggagttcaagaccagcctggccaacatggtaaaaccccatctctacaaaaaatacaaaaattagccagacatggtggcgtgcacctgtagtcccagctactcaaggagaacccagctacccagctactgaggcacgagaatcacttaaacctgggaggtggaggttgcagtgagccgagatcgcaccactcctctctaggctaggcaacaagtgtgagactctgtctcaaaaataataaataaataaaataaaataaaaattaaaaccaaatgccaaaaccaacccacaaaataaaccttggttaaagtagcctgttcattttgctttaactatgtatattgcaccagattctgccaggggctcagcgtataaagatgagacccctgccctgccagacaggtgggatgatggccataccttgagttagtcaaggcaccatctggctgtgtaacaaaagctaaaacatcagaggctgagcagcactcggacccacgtcccagtccaagtgtcagtcgttatgggggcccaggacagcccggacctagttcattcctttggtgcatcctcgacacacagcttccatctcttgagctgagatggttccagctcctgccgtcatgtctgcactccagccagagggaagggaagaagggagaggggaaagggcaagtgtccctctttatttttaagggcatgacctgaaagttaaacacttcagctccttcccactggccagaacccagttgtatggccgctcctgtcatcagggaggctgagcaatgtattcttcagctgggcttccctgtgcacaaccaaaacttcagttactatagaaaaaagggagctcagatattggggaaacaactagcatctgtaccacatgcactgatagctctctttgtatgaacagagctgtggcaggccctatgccagggagaaagtaagattggaaaagagcttaccaaggaggtggcatttgcactgtgcttaaggggcaagaaaaacgtcttccaatcaggagccacaaatgcttggctgaagtgctactgctctttcatcctggagctggaacagacgtcaccagtcaatcatgatggctgctgggtgcactggctaacatctataatcccagcactttgtgaggctgagggtgggaagattgcttggggccaggagtttgagaccagtttgggcaaattgcaagaccctgtctctgcaaaaaaatataaaatgtagctgagtgtggtggcacctgtagacccagccccagctactcgagaggctgagatgggaggatcgcttgggcctaggagttcgaggctgcagtgagctatgattgcaccactgcactccagcctgggtgacagagcaggacctgtctctaaaaacaataaaataaaatcaaagttttaaaatggaaaaaaaatcatgagcacataactccagatgtatcctcaagatagcaaacccgggtgggcgcagtggctcatgcctgtaatcctggcactttgggaggccaaggtgggtggatcacctgaggtcaggagtttgagactagcctggccaacagccccatctgtactacaaatacaaaattagctgggcatggtggtgggcacctgtgatcccagctacttggaaggctgaggcaggagaattgcttgaacccaggaggcggaggttgcagtgagccaagatcacaccattgcactccagcctggagaaaaaaagcaaaactctgtctcaaaaaaaaaaaaaaaaagcaaacccagggccaggtctgtagccacatggccaccttcttccctgagcatggaggcagcctcagaaacctgccccacatcacatcagtgggcagttgattgggtcagcctgccagttgaaccctatttgccacagtcattctccatagtaaggggcattctagacataccccccttcccagggaagaataagccgtagctgcctgagcgttttatccagtggtgtgcatgtcttttcccaactctgtgtttagtgatgtcctgtttgtagcttgaaatttgccacagtgggtgtgtttacaccacaggaattggcaaacactacatatcaggccttacctcctgctccctactagggtaggttgttttttttttgttgtttttgttttttgtttctttttttttttgagacggagtctcgctctgtcgcccaggctggcgtggagtgatgcgatctccgctcactgcaagctccgcctccctggttcacaccattctcctgcctgagcttccagaatagctgggactacaggcgcccgccaccacacccggctaattttttgtatttttagtagagacggggtttcaccgtgttagccaggatggtctcgatctcctgacctcgcaatctgccctcctcggcctcccaaaatgctggcattatgccactgcgcccggcctagggtaggttgttagaaatgtaccagcctgccagtttcagccttgtttgtctttcatcctttttttttttttttttttttttgagacggggtctctctctgttgccccccaggctggagtgcagtggtgtgatcctggctcactgcaacctctgcctcctgggatcaagtgattctcctgcctcagcctcccaagtagctgggattacaggtgcccaccaccacgtccagctaaattttgtatttttagtagagatggggtttcaccacattggccaggctggtatcgaactccttacctaaggtgatccacccgccttggcctcccaaagtgctgggattacaggcgtgagccaccgcactgggcctctttcgttctttcttaatgaaaatcttcctgaaagatttgcctactgatgtctgtgtcaataggtactgcctgcgggacagagcctgccctccttttgaaggtctttctctgtctgggtgaccatctgcatgtcactccctgctgctcagaactaaagatgtagctatgcctggggtaggttgggaaaacctgtgggaatcacagagcttgctgtcatgctgtgttctggatacctgaagcttggcaggcaggtgggatcgagggtgggcattaggaaagtgatgtggctctataggaaggggacataggtcctgagattttaggtccccaattggacaaagctgttttttttttctggataaatgttctagcttattcataatcgagtggtcagttttcttttcttttcttttctttttttttttgagatggagtctcgctctttcgcccaggctggagtgcagtggcgctatctcggctcactgcaagctccgcctcccaggttcacgccattctcccgcctcagcctccggagtagctgggactacaggcgcctgccaccgcgtccggctaattttttgtatttttagtagagacagggtttcaccgtgttagccaggatggtctcgatctcttgacctcgtgatccgcccgcctcggcctcccaaagtgctgggattacaggcgtgagccaccgcgcccggccaagtggtcagttttctcagctgccgggtcttgcacaccttgctggctctggagaccatatgcaccatgtagaccccatttgtttcctaccctcagtgttgggggaggggccaagggcctgtcgatgtgttgacacctggccattcactggccttgaatgtccacattcacctccttgaaatcgatgccccgtatcggaggctccatgtggatttgggggcagaggcctgtactccagatggtggggtggccttcaccaatcaggcagattccctgccctgccctgccctttgggctctgtagctccagatgtgtgctcaagatctgtggccacatggatgggacaagccacagagactcagactccgtggtccctgtgaccagagtagccgtggccctgtctgggaatgttcccaccctgttgctgaaggtgagaaatttctctgtgctggagaacagctgtgctgagaagttggcccatctggcttgcaggactgctggggcaagggaggtctgctgccggtctcttccttcctcctctgactgggtgctccttgtctaggttccttgcagcaaaagaattctctaatttattttgttcccttattgagtctctactccatgaagcccacctcctaatcccagctgactggctcccacctcctcaagaggaaggccaggggcagacgaggctgaaggaggctgactcccctgtgccttcgcagtctgagctgatgctgctgtatgttcacagggctccttcagcttttaaaaaggcttcaacacgttcgtcacacgcttgtggctctcctggatgccacactaactcagtaaggcctgagttagaggctgttcctgaggctgtgaaaatagaagaagggtccagaggagaatcccttcatctgacgatcccaggaaggcttcctagaagaagcagcctctgagctgagacctgaagacagatcaggcctgagtcaggccagggagggtgtgaggggcccaccaggcagagggaacaggatagggcaggcacagaggtctggcacctggcttgtggggaagtgtgagcccctgggcatgaccaaggcggggagaagtggcgtgagaggaggcagatgtggctggcaggagatcggcggccccggccttgctgagctccactctgtatgcaccaggtgacagaggctgcccaggacggtgggcagggaagtgacaggtcacatggtcatcccaccaacagccgggagtccagcttggggggacccaagaccctggggaaggcacgagtcaggggcctgctagagccaggagctagtgggagaaggaaacagtgttgcttatgaattataaacagacactcccgcaactttctctgacgtgatacaatctcaaagtgggccacccagaggtgggaaggtgacttctggctctccaggccttgggcctgtcttttttttttttttttttttttttttgagatggagtctcactctgttgcccaggctggagtgcagtggtgtaatcttggctcactaccacctctgcctcctgcgttcaagcaatcctcctgcctcagcctcctgagtagctgggattacaggcacctgccaccacacccggctaatttttgtatttttagtagagatggtgtttcaccatgttggccaggctggtctcgaattcctgacctcaggtgatccgcccaccttggcctcccaaagtgctgggattacaggcatgagccactgtgcccagccgagcccatcttcaagttctccctggccctcagtgtttctgtattagttcacccttttggctccctgcttttaagagtctcccttaagactgtccccaagtggacaggtccccagaaccaaggagcagccttaggagtccccagttacagacactccagggggtccgtgtggccctcagcctctggcctggttccggcagccttggtcctttgtgctgtctctcacatagcctggccagagctggccaggtcccttggctgggccgagtcatcgtggccagtgactcatgcagggggagaaaagtgaggagggggaacagagtgcgagggggactgtgttaataacaaacccattaggtccctgaggtcacttcacaggagggacaaatggttcatttaggttgatctggctgccggctggcttccagagacactcagggtggggaagatttcattatctggggaaagcaataccagattgtctggaggggcccagccagcgcaccccgcgcttcctgtctgcctcccacgcagagcgttctgttcccaaggcggcaggccaagagcgcgagccgaggctcaggtgcaaagaggggtgcggcatgggggcactgcagggcacggggtgcatgcatttttatttatttttttactgagtgttagggtaatttgttaatggggtatatttggtgacataaaaccttctgtcgattcatggcagtctggaacggagtggaagcgtcccactcctggggaacccccacacacatttggctgtgaacgtcggtgcctttgcactggagcctctttggagtgtgctgggcagagcggagaggttcctcttctctcttctccatcatcctgtggaggtgtcaacatgtagccagagatggtcagtggcagtgaggagaggggggcaggaagagaccagggctgggggcttgccagcccacagttctacccctgaacacccatggcctccctgttcaggtcagcgaggctgggggcagagacgggcaggggtcccccaatgttgggcatctccccgctccctcatactctggatttgccctctggagaaagctctggagcacccagaagtcctggggctgctggctgaggtggggagcagagcccagctgtgcctggaggctccccacttccactcagcttccagggacagtctcagctgtgcaggcccaggccgctgaggctggctccagaaatttcttcacaaccaccactggatggaaaaccagttctctaaagggccccagagccagttttgtttcttcttccacaggttcccatagttagagcatcgggtctttgttagagatgcagaagagacgatgtccccagcccttatgtggttcggtctccactgtggatgttggtgatcttagtctccttctcaaaaccaagagggctgatgccccacattccaggcccccagaaagagccgccacccacccacaccgctacatcttctttccacttttctgttccggaaagagtagagtggatatgcgctcctgtagaaatccatctacagcctgactgcagatgtattttgctcccttattgagtctctgctccatgaagcctgccttgtttgtacctctttctctctctttctctctttcttccctctcttccttcccttccgttcccttcctttttctttccttcctgtcttattctttcctctttctttctttcctctctctctctttccccctttctctgtctttcctatcttttctttctctctctttcctcttttttgaacagccaaagatagaatgaatggcataggtaggtactgagctccctgtaactggaggtgttcaagtgtagggtggatgggcatttatagggcaggcattgaggaaggatctccctgggattgtggatggcaggacaggccctgtggagccttctgagcgggtgcagaagagggagggcatgttcctgctccctgcccttcccgggttgccaggccgccactcccaacctccaccctctttccttccacctgctgggccttacgggatgggcagaggcattgttagaacatggagccgcggtccacagagggccagcagggaggagagctccctggggaccacgtcgcctcagtcactgtggtgactttgaaaataaatgctttcttctctgcttgagtccctgttgttcctgctgacgtggaactagggcaggctggtgactcagccctcatccctgcactgcatcggtggcaagttgcctccagcctcagaccccacagagcagggtgccttcttcagaaaaacagtagggaggccaggacaccaagggccccagggacagcctgtttctcctggctggcatgagttctagccaagcctcctggtaccctgggggtgaggaggtaccagctgtgtgctttagtcactggctgctttgaggctgggtcggtgccaggctggccactccttcttgtcccctagtgtgactttgcagagctcccggaagggtcagagggtttttttccatcactggtgtccatgggatactgtgtccccatctcatttttgtactccagtctcagacgggtgctaggaagttggagactttagccatttcacgactgtgtcttgcggggctggagtaggaacaggagtaggaggaacgctctggtcatgggactgtgtgaagagagaaggatcaggaagaaaacatgagctatcatgtctgggttatacctcagcagagccgctggtggcctcccaggcatctgaatttactaatcacaaagctcaccaggtgtgcaaataaacaaatgctgttcaggaggcacagccagggttctgctggagagggatcatcttggaggggtcatactttccacccagtccttcagtccttctgtcctgtgtgtgtgcagcccctgaccaccaccatccctgcccctgccacttgctcccagggttccatcaggttggatgttattgcaataaaatgtagcaacagaaggtccaggcagtgctgcagtccctggtggtatcatcagagccagcaggcagcagggctggggaactccaagctgattcagtcccaagtgccggagcggggagctcggatgaggtgggggtggggaaccggggagccatggagcagagcatttgctgtgctgaaggccaggagcctccttgggagatcatgaatttagaacactaatactttgtttaaaaagtcccctgccttggagataagagctcaggccgctgtggtcaggttttgctgtaaatgttctgcacaaagcaggctggggggatcactgggaagtctggggaacagattggtcatgtgcttctttgagtgaaaccttatggttgcattgaagcggccaggcagagggtgtgatggggtgtggtagctgcacaccggctcagtcaggctgaatggggaaatgcaaactcaggtggcctgaaagagacttagtggtccacagcctggtggctgctcccagtacaggtgatgtaaagagagaaggggttccgggggcttggcccaggtggaaaccatgcactgtctgtgatcctgggcatgtcgaggctggagcaggtctgcttggtggctggcagaacgcacatgaagaatccatgtgtgttctgaacgtcccctctgcccctttgggctcatgccccatcaggagtctcccgactctgccattctgcaaaggaaactgcgctttgtcattgcacaggatcgaacaggtgtgtgtggagtccctaaagccactgtctcaaggggtctcatgggacaatgggagagttgctgtgatgtttaagactaaagtgatggctgggcgcagtggctcacgtctgtaatcccagcactttgggaggctgaggaggatggatcacttgaggccaggagttcgagactaccctggccaacacggtgaaaccccatctctactaaaaaaacaaaaattagccgggcatggtagcgggtgcctgtaatcccagctactcgggaggctgaggcaggagaattgctccgatctgggaggcggaggttgcagtgagccgagatcacgccactacactacagcccgggcgacagagtgagactgtctaaaataataataatgctaataataaataaaataataataataaaataataaaagcaaggacttgaacaaatatttgcacacccatgtttgtagcagctttactctcaattgctcaaatgtggaaggaatggatatacaaagtgtgtgtacacacagtggaatatcattcagccttcaaaaggaacggaattctgtcactacatgtgaaccttgaataatgaaccttgaagacctcatgctacgtaagcctgtctcacaaggacaaatattgtatgatttcacttatgtgaagtcaaattcatagagaaattggaatgacggttgccagcagctaggggaaggaaggatggggagttattgtttaatgaggacagagtttcagtttgggaagttggaagaagtttcggaggtggatggtgttgatgggtgtacaatgtgaatgtacttaatgtcactaacatggaaacttggttaaaatggtaaatttgtcttttttgtttttgttttttttttttttgagacggagtctcgctctgtcgcccaggctggagtgcactggcgtgatcttggctcactgtaacctccgcctcccaggttcaggcgattctcgtgcctcagcctcccagagagctgggattataggcgtttgccaccacgcccggctgatttttgtatttttagtagagacagggtttcaccatgttggccaggctggtcttgaactcctgacctcaggtgatccacccaccttggccttccaaagtgctgggattacaggcgtgagccatggtggctggccaaaaatggtaaattttatattacatatattttatcacagtaaaaatgcattgctctattagaaaaatgatagatttttacaatatgaattaaattacaagttatgaaggaaaaattaagcaaaacattaaaaaattacttataagtaattatatttaaaacaaaagataataaatacacaactttcatcacctcttaggttttttgcaacatttaactattgtctgtcctgttgcggttatgttcttgaggttgtatttgtatgatagaaacactatattcgtggtgactaaacatctcttctcagtctcacctccaatgatgtcatacagataacttgaaattggccggctgggcacgatggctcatgcctgtaatcccagcactttgggaggccaaggcaggcagatcatctgagttcaaaaccagcctggccagcagggtgaatcctcatctctagtaaaaatacaaaaattagccaggagtggtggcgggtgcctgtaatccgagctacttgggaggctgaggcaggagaatcacttgaacctgggaggtggagtttgcagtgagccaggattgccccactgcactccagaccgggtgacagagtgagaccctgtcaaaaaagaaaagaaaagaaagaaattggccaaggcaggaatattgacaccacaggaataggcaagcgctacaaatcgggaaactgagtgttgttgcttttgctggccccaggtggccggttgttgaccgttaactggcacactactggaggagggaggttcagactgattcgcagagagactagaggtagaaacgcaccatggtttggatgctgagggtgagggaaagagaggagtcaacagtggtgcccggagacttggcttgagcaactaggtggatggtagcaccgtttcctaagatgaggggctgtgggaacttgaggggctgtggaaggctctgccactgacggacccagggctcggcagctctgggaggcctactttgtgtcaggccacgcagagataagaccatctgggccctgcccttgggaagtctctgtctatgaggacacagcctgccacctaatggggtgtcccgtctggagcctcagtgttgctgggagaaagcccctcaccttccttcgctctccgagcctcttttgcttccctgccagctgagcctctccatggaggctgtgcctggaggggggtcatggatatggatgtgtgcgccaaacgctgcttcctcgtggatttcctccccactccgttcccacgctttgtaagcttcatttccccggggcctgacctgtggggtttctctccagacctgctccttcccatttccagaaaggcgtgcaggggtttcctatggctctcttccctgtccccatcccccttcccttgggacagtgatctgctggacgggtgggctacccacagggtttgtgattgcttagacatctttgctgtatgaagctttgacctcaaggcatgatgcagatgggaataaggcacgagtttctcctggctgctgtaacaactgtcgaaactgggtggcttatagcaaggggaatgtgtcctctcacagttctggaggccagaagtctgaaatcaaggtgccagcagggccagcttcctctgaagactccaggggaaaacctttctttgcctcttccagcttctggtggccccaggtgttccttggcctgtggctgcatcactccggtctctgcctctgtcttcacaaggcctttttctgtgtctctgtactttcttttctgtctcttagaaggacacagcattgaatttagggcccaccttatcttgagatccttgcctaaattctttctgcagagacccttaaacagaatcaggtcacatttgaggttccaagtgggcatatctttgttttgggggggatcaccggcccactgtaggtctcgttgtgcactgaagacgcaggcggtccctttggccaggcctgcagtcggtcttgccttcttttgtgaccgtggaagaatgcaccttgctggatgcacaggcctttatagttcttttgttcttgccaaatttcagctcagtttcctctctgctgccggcgtgcatcttctctgcccagtgccccttctgggactgtgtgtccaggccctgaggccctagaaaaggggggtggagggcctcctcactatcctgtagcaatgaggcctcattaaaatcctggagccccagactggacccagcccttagctatgatcaaaggacagctcgggatatgattaaagggctagagaaagatgatttaggctgagaaagaggaggccaaggagcaactggattgtccttgaatgtggaaaaggtaattatgacttgaagggtggtgcccagctgtttcccatctcctctgaggacaggaaaaaaaaggaaataaatgatgtacaattagagcagttggttagatacgagggtgaacttcctggctgggagtatggccaagccctgatttgggtttcctgaaagagctcggggaacctccttacctggaggtttctaggcctggtcatgtggctctgagtgattacattgaaggggcagtggctggggctggagccggtgggctctgagcacagtcacgaaggcatgcgcactttctggctgctctcctgccattgtcccttgggttcccattttggtgaggcgtgcaccctggcggcgctccccagggaactaaatatgtttgctgcactgtgcgtggagatggagaatgtacaattggctgaccctgtgctaatctggtggaactccatgccagccctgggaaagaacaattgcatgggtgtgtccacactcaccaggtgctttttagaaaaacactcgagaataatgctgtggcttaggatggctgttgtgccggacccggcatcttcccaggggggctgtgttgttgggctgagtttcttaggtactggacccccaaatccccaaatacggcgtggacaggtggcccagtaggggctggactatccgataggcccaggtgctggagttcagacaagacataccctggcctggcgtggaagatacggggtgctattaatggcagcaatggctgcatttctgaaacccgggctcccaggccgacgagggtgtgcacgcatctgaaatgtctgtggttttgcagttcccatgtccacaaactcacttggttgaaaatagttcaaaatatccaaagcatgagggagggagtgcctgcttttcttaaaaaggaaggacttgatttcatctacttaaaaagccacccaaacctagaacattttccgcaagagaccccctgccccccgcctctccagaatggctggagagtctcagcactcctgcacatttgggatatttcagagggggtggggaggggcaagtgggcagcgagcgacctcagacccaggatgagctgtcaggcgctccccggccacacattcaagggaccggagtgcagttgtagcgttgcggcctgctgcttcgggggtgggggtgttgttccatgctgtgaattctcacatggcccctgactctgggcagaggccgagggtctaagggacggggtgacagggagagcatgcaggagtgggtttctggctttccagggcgagtggaagaagcgcctctctctcttgtaggtgacagacctggggggcccttcttgaggatgagagcctgttgcttctcaagttctgtgtctaacccaggtccccaggtctaccccagcccctcggccctgcctgccttgtggatgatatagtttaagggtagagaccgctggcctggagggaaggctaggcctcaggttagggcccagaagggagggagaagcccttggggcagctccctttctgctcactcactgcctagctccttccttcacaccttccttcggaaacgtctgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgctcatactggggtctccctaggtccactgtgttccgttgagcctcctgcagtccccgagtgaatgtgacctccctgcccctgcctctttgcaactcctccctgcgaccgctcctccaggggccttccttgtcccaaatgtccaagtggcacgacttagccggtctgaccactttccagtaagcccttatggagagaggccctgtgttgtgcagagctctcctcctgcctgcgggatcgaggtctctgctctcagttcctaacagaaagtgtcgggcccccagtgggatttctggggaagaactctcgtgtctcaacgggagccctgtggcgggaggggaggccagggtttggggttgtgttcgttgtacagctgtcaccatttgcactatgaaagttgttagtgccccttccttgggtctctgggtgtaactccacccttgcccccatgtgcctccatctggagctgcttctgcggctgtctcccaagccagttttgtgaccctgtaatttagtccaagacaatgggctcattgagaccatcctggtgcagcagttggcaatcctttggctctgggggaaggtttctcagtctcggggagtggggcctcaatctgctggttccctgtgtttatcagtctcccccttgtgtgtcctgaatggttttgctgggaattctggtcttagagccatcaggtggcccgagtcgataggcgtgagagagtgtgtgtgtgcatgagtgcgcatgtgcatgggggctgacctggggtatggaaaggtggccctccctggtgcccaaggagcctggagtatagttggagggtgtgggggtgtgtatatgggagttggacaaccttgggtggacagacagacgtggggaagggatgattgaaggaggtggaggagagagtgtgattcagcccagccaggggtgatgtggacaggcagcttccgaatcagggtagagaaaagtcaccactagctagcaggggagaagtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaaggtaggccgaaagggtggggaggaaactgccagctccttacagcgctgggatggtggccccagggttcctgaggccagcggatgtgggtgcctgtcaccatgtgggttgctgaggggcggagactccaggggccaccccaaagcaggacgagctctgagccacggcatctctgggggcagttttccaatcgagcagacgtctaggcctggaatcctgtaacagaggccacagggccctgatcagggtgttctgggaggcttagaactagtggcagtatacagggtagacggcaagtgacctggcatggggaaagaggcaggtgcccaggccggcacagcacacccgtaaggaacaggtagacgggaagccgtccgtgggcctgtgtgtgtgctcggagttaaaattctgccaatgtcccatgtcctgggcacatctaccccctccctggggagcacctttctcttcaccttttccttccccgcctgtccccttcacccagggccttccccatccctcccgtcttggggaccgagggcaccatggctttatgttccatcaccgatgagttgcacagggattcagtccttccgctgttcaggccgggtccttcaggctcagggttcccaggaatggagagggtatcagtgtcttccatggactcaaacttcccgcatcccgcctttgctcccccttcaagataggtctccgagcttcaaggttttagggctctgtggaggccgccacgtagcagcaaggagaatgttttgtatttggctgatgagatttttagagtctcattttctacttttccactgtacaaacgggcctccaggcgactgcagcacccgccactgcccgtaatagggtgacaagagggatgaccctttcctctttctcccttctggttggtggaggcacggggctggcggacggcatgtgctttcgtgaattcaggccaaatctgttatcgcaaacacgattacaactcgggtctttgtgtaacaaaagcctttccaagtaccagctgttggcctgctttgctcagcggtgtttgctgtaaccagatttgcacaccgagaaagaatccaaaagtccttgatgtttgttgaaacaatctggcccaggacccacgtgctcagatcccagagctgtgtggcatctgagcttctcccgagcccccactgtcgcccgaggaggacccccagatctgtgttctggaggcagagcaggctgtgggacgggcttctgggtgggaaggaccatgtggatatgccttcttgtctgagagtcccaacacctccgggacgtgggagctggcgcgctggcaggattcaggtgcctctttcctctctagagaaaaaggccccgttgcttggtaataggtgcagacctgtccctaattaatgccagtaggcctcttgcgtgatgaaccctgcctttcagccaagactcaaggcatcctgtgaatactgcctctctgcagtttgagcttttgtggtgggaggcaggagccatggggagtgggggcaggcctcttacacgggtcccacagccactggcagcactgacttgatgctctttgagttcagagcccagggccagacagacccactgtcccgactacgagttggttcatttagaggggggcggacacagcacccaggcagcagatgcactgtgatcagccttgcagcggggctgtgggttctctgggctggatgtccgggaagaggcaggtggaggtaaacgccaggacacccctgcagtgactgggtgactgcaggctggaaatgctttctgtgggctgtggctgtccaggaaggttttgaatggggctagtggacagagtttgcatccagaggggcagtgctttggaggagtgaggggtatggcagtgtagggatgcccaggccgccctcactctgccattggaaagctgggcggcttcggtttcttcagtttcttcgcctgtttccctgcctgcaaagtggggttagaaacagctctctttgagggttgctgggggactctgagatgcagcccatggcgctgagcacgggtcctgcctcctacgggtgtggtgggtgtcgcggctggtgtggcatctgggcgggaaaagggggcatttgcaaaggacaggtaggtttggatgcttaaatatgcagatctggggatgggaggtctcaggcaagggcctgtgtgatgccactgtatgaatgaggccggacagcatggtcaccactaattatggaaagcacggcagacactagtgccagtagcgcccgcctgggggtccctctgagcccgacaggtactcaggctcccagtgcagccatgggaccccccttttcctgcctggctgacattctggaggctggcgtcatgttggctgcaggttcctcttactgggaggttgtcctggtcttccctgccaccatctacccccacccccaccctggagtgtcacagatgggtggaccatatgcccatctgcagggccaagcgctgacaatgaggtgagcacttgctggatgaccggaccatgaggacagcgggggcgctggcagcctgcgttcggctctgcaggctggcctttccctgaaaagcggttgtggcagagtgtgcatcccagggagtggtgcctgctgccctgaacattctcatccagcaggcctctgcaagggcccagtcaagtgtggtgcagagctgggctggcagctggaacagtctcatcttgtctagtggtgagaccaagggctgatgggccaaggctgcgtgctgcttgcccagcccgtggacccatccactgagcacccccatacccctacactgggcccggggtgtcaggaggtggaggggggactgggtgcctggaaaaacaagcccaccgagagcctgagcccccaggggtcagtatcaggcagtcaccacggtgcccggtacacagtggccacctggtctcgtcggctgtcttggtggtggagagcgtgcatggtggccgtacgtgatgggcatcacccagggtaatacagatatgcagactgtgcatttgtctgtaggagccagggacttctcagcctggcaacctgtgacctctgcctacccgttgggagagaggtgctgttccctgatagcctggtgccgggagagcagaactagggtctcctcctcctttctccacctcccatttcttacatgcccaggcatcaggggaggtcacactcagggatgagtcttggccactgggttcagggcctcactgttgccatctcttccctttgccagccagccaaatgcccgtccatcatcgtgccggggatggggctggcctgctcctctgaagtctccttggtgtatagcctaggctggagccccggacgattccgccaccccctcccccgactttttctttttattttgattcatcccagaaacccagccaaaaaccaagttcctgtgctctcccttgacaaagccactgaggaaaaatggtcaaacactgcctttctttccaaagccctcttggtttttcccaaatttggaggctctgagttgcttatgagaccaaagggtccggaactctctggaacacagtcccagaagtgggaggatttgtcatctctccagccaaacagacccaccagttggcccctagacacccccaggcgcctggggcatttctgggctcaggctgtttaatttggtctgcagagccccgaggctccgtttagactgggccagcagacagttctagagacttcaagtttgttgtcgtttttaaaagtcctgccaatgcccagaaacttagagggacaagaagatgacctcgatgtcagccgggaccataaacagtgaggcccgcccccccccccacccatgcctgcctccactgctcccgtagctgggtctccaggggattgcccgtggccatgggggaggccgggaatgcggggctcagactctactgggcttctcgtatttttttgtttttccttgtccatcttctttctcggaaatttctgaatatccccctacagcctttggcattctgtcactcctggcatctctgggccaactgggaaagccatcatttgtccaatatccagaaaatcaaggggcctggccttaaatacattgcagtgccctcctccccacatggcatcgaatttcctgtgtcctcaaagccaggagcctgtgccttggatgtgggcgatggagccttgcagacacctggagcggctttcctgggagagtctccctcgccttcccatccacccgcttcccctcccctgccccaagctctggtcacagcctcggaggggtcatctgagtgtaggttgcctccaggtgtacagttggaggggggcagttaccccacatccccctgtctgctaggggcacccccagggactcaggtcttgagggacagcggaagggtggggtggggagtaggccgttgtctcgtgccacctgggtgttatgtagactctgaatgggcagttcctgggagctggtttttccttctcaccccttctacagtgctgcccctctgaggggctggagctctctggagccctttgcagcctgtggcaggtctttctgattctgtgcctggtttcgcagcctccaacccatagccagtggcatgaagaacattcctggctgtctctacctgtggcctttgcaggcagcagttccctggggcagggcctgggggtcctggcacctccttgtgggaccccttgggtatgagggagggagccacctgggccacagatagacccccttcctgtatccaggaggttcaggatggacctgtctcatctttctttctggtgggaagagagcattcctggccatggggaatgtggcctggacagagccacctagcctctcccctcccccaggcagggccctgaaagatggagatggctctgctcctgccaggtcaacagccagcagtctggtggatttccatgcagtccaggcaggatctccttctgtccccaccccccaccccatgtgcaggaagctggttccaagcagggacccttggccccgctttccacgtgggtgggcagtttccctgcgaggggcaggccaggcccctgccctatgtcccccagagaccgatgttatctacagtaagagcatacaagtctttttggctccaaaccaggcctggaggggtggtcttctcctctgtcctctgcctcttgccccccattaaaggtcagggaatggagtgctctgtatgtttgctggggttgggttttttcctttggtttaaaatgaagggctggaatccctggtgcagactgcacggtgagaggtgctccttgggatccactcgaggagcattactgctgaatgccctgccaggccaggagcatcgctgggggtgggagaggcagttggcttatttgtttatccaacagccatccatgggtaccccaagggccagctctgttctaggcactgggggtctaggcatgggctcaggagaaggggtagaacgggagggcttcctggaggaaggcttcctaaccagagaccggggtaggagtttgccaggcaggtgatgctggccagcttctcttgccattttccttttctttttttctttttctttctttctttttttttgagacagagtttcgctcttgttgcccaggctgcagtgcagtggcgtgatctcggctcactgcatcctccgcctcctgggttcaagcgattctcctgcctcagcctcctgagtagctgagactccaggcacgcaccaccacgcccagctaattttttgtatttttagtagagacaaggtttcatcctgttggccaggctggtctcaaactccttacctcaggtgatccgcccaccttggcttcccaaagtgctgggattacaggtgtgagccactgcgctcggccttctcttgccatttctgcagactcatagtgtgtgtggaagactgtatgtctgtgcctggcacagctgccctcggcactcaggtgggaggtgggggagagggctgttggtgccagcacaggtcatggcatgagacaggctcccgcagccaagcggggtgcaccgcagcattggaggggccctgctgcgcacgagatccaggctctgcatctgtcctcctccccaggaggcctggagggctgggagggaccagggtggtgaaataacccaggtgggagagaggcactgttggagaggcagagggagctgcaggtttgtagcagcgagctttaaaccctgggcctccaccagaaaacctcagaaagggctgctttgcttttttttctaaactacaaaagaaacccttggccgcctgggccccttggggtcgggtgggggaggagatccttcattcgcacctttgcaggcccagtactgtgcagagggaggagggtggaggcaaaggcgagggaggagggtggaagcaaaggcggggtccctccctagccccgctgccctgcctggttgctgctctcagacccctactcctggcccggaaacatggaatcttgggacagctggggtagggggcacagaacggagaccctggtgagggaggaactctttctccagccctggctgtggccacagcaaggccaggctgggaggacctcactcaaatatttacatctctcctaatatttaaatgatgaagcaggctcctgcacacagctgccctggagccagctgttgcctgccctaccctccctctctccctccctctttctttccctccctctttctctccctccctccttctctccctccctccctcttgcattctttgtctctgacccaagtccaggcccttccagctgttctctccttacccacaggcacctcctgtgactgagcttctccttgttatttttcataaccatttcctttaattgagcacctcctaggtgccaggccctgggctggtactttgtatacaaggtgtcttttaatccccacgagagcccaacaaggtagattgggctgctgaggctccagcgctggaaggccggcccgggtcctcccagtccgcacctgcatccatccatcactcccccactgtggagacctgttccctggcccctggctgagcacgatggaaatctctgtctactagtccttggagagtggggatggctgagggtcccgaccctggggtctgacgggggctgcctctgccccacttcagcctggctgctcttccactcaatgactgagtttgcaaaaccagaataacagtgctacctggctggtactttgggtggctgggaggcgtgggagagggtgcacggaggggctgagcgaggtgtcagcatcgtggggatctccgagggtagccttcccaggcccagggcggagtgtaggcagagggcgcgatggcccagcgtgccggctcacatctggccttgcccttgcccacacggcaatgtgggggagtcatcagcctctcagtgcctcagtttcccatctgtgcaatggggacaagagtaaatcactgtcttcaggtatggtaagcactcatacacattgactattgcagaatgaacacagtgagcccttcttaggcttctactacatgccaggcagggtgccaggccctagtggagaggggacaatgatgggcaagctggctcctgccctcaagggctgtcgagcagggaggaaggcggcggctgccctgactgtgacccggagtggggtgattcgcaaagaggctggcgggaggctggctgggggctggctgggggctgctccctctcctgcctgtgttccgtggcagggtattaaactggcttttttcatggatttccgaggccctgactgtgggacctcgggcaggttttgggaccttgtgactttgttcccgcttgtcattcaggcctttgtcctcagcagtgcccagcacacggcgacttctgcatgtccttcagtgtgtgactgaccctggagctgagacttggcagctgaggctggacattgtccttggataactcccggggaggtgggggcagggtggggctgtgagctggcaactccgagtccctagcagcctccgaatggaggctttcctcttgtaggattctcggggaggaaggaggggatgggggagatgaggcttgtgagtcttcaggagggcagaggttcacacctgcagcgccccagaaacactccggggtgcccaggcttacccagccctcctgagccagaaccaccaagagttggggaccagcagtccattttttagcaagatccagaaatgattctcctgaacagtccgagccaagaatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacacacacacacacacacacacacacacacacacactccccagtaaagagtggaaagacatttgtcagaatattgatggaagttacctgggttgtgggtttatagattttttccctttgtttttgtgcattttgcaaattttcggctttgtgcctaaattccttttacagtcaggaacaaagcaatagatgttattttttaaagttcatgggctcgtgcccgtaatcccaacactctgggaggctgaggcaggaggattccttaagcccaggagtttgagaccagcctgggcaacatagggagacccccacctttttttttttttttttttgacagagtttcactgtgtcccaggctgaagtggcggtggcacgttcttggttcactgcaacctctgcctcccaggttcaggtgattctcatgcctcagcctcctgagtagctggattacagacactcatatttgtaggatttgagaatcctacaagaggaaagcctccattcggaggctgctggggacttggagttgccagctcacatattttttagtagagacagggtttcaccatgttgaccaggctggtctcaaactcctgtcctcaagtgatccatccatctcggcctcccaaggttccaggattacaggcgtgagccactgcgcccggccatgggagaccccctcttaaaacaagaataaaaataaaaataaataaaagtttactgtcaaaaagaaaaacacatcacccaacctaatctccccctaggattgagagatgaggaagcagaggccggaaagtgtcacattccctggtcgctggcagtcaggggacctgaggcctgggctggttttctcgtgctccaggcctggggtgtcaggtggagcccctgctttgcccaaaggtctaggtgcctctgccagcactgcttgcttctgcatttttggccacaaggaatgtgggccaaaggcagggtccttgacctctgcccaggagggtgaagtgggctggtcctccttgtccctgctccaaggcccctgcggctgtgcctttggaaactgctggcccgagctagtgtgcggagctgggacagacctcaccgtggccctcgtggggtcattccatgtccgggctggaagggatctttcggtccagcccttcctgttcctcatcaggaaactgagaccagagaggtcatctgcctggcccggggtggggtgtagatggcgcttgtgactcctgcatgccacgtgcagacagtccctcagctgtgggcttcccacgcaagcagccatgctggggataacttggctgaaacctgcgatttaatgaagagaagaatgactcctcctgcagccctgtgccccacaggctccctcctgcccccacccctcctgcagaggggcctcatgctggtgggtgggtccctgttgctgcaatgggcccaggcagtttctgggcagtggaggcttggctgtcttcctgcccaatgtcccctgtagcccacgctgtccgggaagggcggggaagcactcagccactggggacttcacaagatgggtatctgggagatgctgattggcaggccaggctcccgtggcccacaggcaggtcagaggtcacagtgctgagctgggctgagttggcagctcagggcagtgggggtgggggtaccttgctcagccatgggcctctctggcacaagggtttggagtttactgtaaacaactccttcagtttttccttctctcataggccaccagcagaattgaggggccctctgttgatgaggtgtggcctgggaggggctagttgtctgtccacctgatccttgcggacaggtgaccacaggcttcctgccccagggggctgggggaaagatcggggaggcctctctggcttccccacttggaaggaaaatacgggcataggggagacactttacagggacacatttcagccagtaccctctggctgtgctgggggcacagtgcctgccctgcccacaagaggggtcagttctctccaggatttaacttcagccttcagtgcagggcagatgagcactcagaggcccagaggactcatatcacgagagagaagctgtgaccacacaggcactgaaggttaagcagaagagtgggacacacgggtgacctgaaagtcccagggtcagtgtggttagccccagatagctggggagctttgggtaccaggcttagcaggggaggagggcccccgtgacagtttgctggggctgctgcaacaaagccccacgaactttgggggctgaagatggttctagaggccagaagtccaaaatcaaggtgtcgaccaggctgatcctttggggcctctgcgggaggctccggcccaggcctctctcccagcttctggtggctcccgggtgctcctgggcatgtagatgcgtcacgccactccctgctccgtcttcacatggccttttctctgtgtctctgtgtctcgtaaggatgcttgtcattgcatttagagcccaccctaaatccaggatactctcctcttgagatcctttattgcatctgcaaagaccctattccaactcctgtcacattcacaggtccgagggctagggctctggcatgtcttttgggggtcactattcagtccactgcggcagctgatcttaggggaagcagaatgttctaagcttggggtgagcggagggaacgctgctgggtggggagtgggagaccaggctcggagacaccgcggatctcctctgtctgatgagggcgtgatgaggttctcatctcaggtcctctgaatggcggctgcttctgaggagaccctttcccctggatctgcccctccagaaacctccacttaggtccaggtcccaaggtggatggtaagaggcggctgtccctgccacacttgatgggtgagtgtgtgaacggggctgggagcaggacacttgtcacttctgtggacagattccagaggctcatgaatctgctgctggggaaggtgcctgatctagcctgaccctccacccccacctcccccttcccgccccccttcaccagccctgttcccagagcttcacttccccaaaggcaggcgccgtttcctggacttctcagcagctaccccctaccccagacccctctcttgtaggcccctctggtctcagcgcctactcctccctgggcttctgcccctctaccgtgaggcttctgggcagaagtgtggggccccctcgctgtgtctggctctcgcggtataccaggggtcctcccaggggcccgccctgcccgctaggtttccagggagcttttcaagttcttagatgggcttgatggagtttcccaatgcgttgtctcagagcaggaggggccccggctgagtccgagagtcccctcagtcacaccctgggctgtttggggcagccaggcagcccgtcttctggaggtgctgcctctctctggttaccccttctggaatcttctgcgtccagttgcggcccctcctacacagcacacccaccacccccttttacctgtgactcttctttgtcaacctcttcatgtctttgagaatggagaccaggtcctcctcaccctggagttcagcagaacctaaaccaggcagatccgtgtaggttcacgtgggggctctgtggccactgtggctctgccgtcacctccagcccagcttggcgcgctttggatcatgtcattcagtgccggtcctccaaacctctcccctggctctgcaggtctgggaagcagctggctcctgggtgcagctgtgaccggagcctgaactctgctccctggggtcaccgtcccctgtaattaggctgcagctcatattggctcgggcagaggccatcggctgcccgccttggggccacaacacagagagccccgtgattaatggaggctccacctgggccaagtggcccctggtgttaggcgcttttttttttttttttttttttttgcattttttaagtgcttgtaacatttcccctaatggacaatgagacgaggagggagggaggggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgcgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtcaatcacctcccagggcctcgctcctgccttcagcgacagccatttatcagggagtctttgacccaaggagacctgaaaggtcatctggtccctctcctacccccaggcaggccacacctagaccctcccacacagatccgtcccacccttctgctgccttccaccagggacggagggtgggcggccctcccacccaggccctggcggccccaccccagccaggaaattcttcctctttatctgcctcacatctcttcccctgcggcttccgcccatttcccctcaatctgctcctagtggagcagccagcagctggtttagaacccgggggtggggggagcgctagaccagtgcagcacatctgagagtgtgccagaggtgctcccattcccatagctgatttagtaaagaaaagaggaagtccagcaacttagcgccactttaaagtccgcctggaatgaccctgtggctgccggaaccaggggcacgcggtagatgacgggagcaggcacagagaggccttcgtcccggatcagtcgctgttgccctcttggaggctgggctgcctttcaagaagaggacccaaggccctgtgagcggtggcctcctctggagcctttactgtggtcctggttctgctctgcgtaaagagagatggcttgaagcagaagctgctacgtggctgtcccaggcaggcgcccgtagtcccagctactcgggaggcggaggcaggagaatggcatgaacccgggaggcggagcttgcagtgagcagagatggcaccactgcaccgcagcctgggcgacagagcaagactccgtcttaaaaaaaaaaaaaaaaaaaaggagtagagaaatctttcccagaaggcctgcagtcacctccccttcatgtttcagaggtaaaaaaaaaaaaaactgcacatttcgctttttttttttttttttgagacggagtctcgctctgtcgcccaggctggagtgcagtggcgcgatctcggctcgctgcaagctccgcctcccgggttcacgccattctcctgcctcagcctcccgagtagctgggactacaggcgcccgccaccacgcccggctaattttttgtgtttttagtagagacggggtttcactgtgttagccaggatggtctcgatctcctgacctcgtgatctgcccgcctctgcctcccaaagtgctgggattacaggcgtgagccgccgcgcccggccacacgtttctgttcttgaacaggtggctccctgaccctgggtgtggttactccaagaccttgctctggtggggcacaattctggccccaggtagggcgaccgtataacttactgtcccttgggggacacgttagtgaaagggacccttgaatgactacggtgggacaacagatgtgagctgggtttgtcccaggaaggctggatgtatgggcctcttgagccagaggagacaacagcagaaagctctgcggctgatgggaccgagcaggagaagggccggcggaggctggggcaacaacgcacttgcccactgtgaagggcctgtgtgagctgatggctgatgagagggcagtggggcgaggctgcctcctgccaggctagaccagctccaggacacccatatctccttttcagaaccggtgactcagtggctagaaggggcttcagaattgacgggacactgagggagtcgaatggaatggctggagtggccacagcaggctctaggcctcctcccgtttcttttctgtgttctgttcctggggtctatatcctggggttgctgtaacagagtgccacaacctgggggcttacaaacatagcttccggcggctcctggagattcctggcgttccttggcctgcagacgcatcaccatcatctctgatctctggcccctgtctccacgtggctttctccccctgtctgtgtgtctttctccttttctgtcttttataaagatgctcaccattggatttagggcccactaaattcagaatgatctcaccttgagacccttaccttaattacatctgcaaagatccgttttccaaatgtgatcatgttcgcaggttccaggagttaggacttaagacatatcgttttgggggacactgttgaacccactacatttaataaacccagagttggtgccaatgtcccctgcggacaccatagcagattctggaggttccttgtaaaggaatccgtaggacttcttttcccttctggagggatgagactgtagctgggctggggaaagctgctggttcaagctggggctggttcagctggtgctggcttgccaggttgttagagagctttatccagggagaaattaacatcacaaagttgggggataagagaaggtttggaatcccaagggctggctgttgaggtcagctgcccacccctttgtgttccatcttacagggacccaggcctgccagtgctccgtttctggaaggaatgctgtgggctgctgtgccccataggcagggtggagggtccccttgcagccagcgagctgctcttcctgtagcgtgcagagggaaggaggaggcttgtttatttctcttggcctcagccgaaaatccaaccacaggctctggcactaggcagacctgctcattctcacatcatcattgcagagtgagccaggcctcttgggtggggctgtgatgagcaggaaggacctccggagtgcctgggacttcttgggcccagggttgccagaggcagagagaaagaagcctcctcctaacacttgagcaaagatagtcatcagaatccatcagagtggcctcctgtggctcttccctgggtgctgacccccctggtgcatttgaagttttcagggatactattgacgctccctgcacctccatccaggggttagtggaaatggttcttttcctccttgtccagaggtactgtggatgatgaccccaggtcccagacctcagtcattgggccacgtgtgcagataagcctgggcagtcagtaacctttggccaccaagctggcctcctgcggactgggccggcactggaggcgggtcttagctgctagcactgtggcccagccaggcctggccttgggaaggcagagggggaggggactgggaaagggattgagctgggggtggggtggtaccctggttcttccctcccagacctttggcaggtttgaactatctggctgcggctctctaaggagggagcgcctcctccgccttgatgtggactttgccttctgttcacgttgtccctgtccctaaacaaatgtggctctctgtggggagcctgggggccgccctccactgacactgctgtttcctggcttccctttgcaggctccgctcagcttcactgcgcctatttttaagcctttccttttggacggttttgcttcctgagaacacacccctccccatcaccccaactgtgtcctcctccctatccggagcctgctccacctgccccaggagccacctccctcctccaccaagcagcccaggccaattctggagggctaatttgtgtccctccagaagcaggtcctgagacagggatttcagtgggaggggacaccaggggatgcctgagtgtgggaatgggccaggcagggaatccagccaataaagggtgcctcaccagctcattgtgaccacaggtggctgcccagcccccataccgggcagcatggggagactgcagaccgtgcccccagccttgtcccacctggggttgggtaagggagctggggtttttatacttcagttcttggccaaggactgcactgctcactccttccagccttccgagggcttgggcactaggaaaggctctgggtggagacacggaaataggccatgtgaagtcagtgggcgtgattggtagcagtaaggccaggacagccttggtcaccagcaaggtgaccacacatttcagcatgcacagcccccacagacacacacccaggagatggtaattacaccagcaacagtcacccctgccgcgtgccatgcctgcacccagggaatcttattttttatttatttatttatttttatttgagatggagttgcgctcttgttgcccaggatagagtgcaatggcacaatctcggctcaccacaacctccgcctcctgggttcaagctattctgcctcagcctcccgagtagctgggattacaggcatgcaccaccacgcctgactatttttgtatttttagtagagatggggtttctccattttggtcaggctggtctcgaactcctgacctcaggtgatccacccacctcagcctcccaaagtgttaggattacaggcatgagccaccgcgcctggcctcaggggcaccttattaccccatcacctcctacagcaggtgacactgaggacactgaggctcagagtagactgtggttatgtcactctcctgtttggttctcctgctctcagccctgaaataaagagcacggtccctgtgcaggcccatacgtcctgtctccagccctggagcagtccttaagctccttgaaggcacaccaggcctttgggcctcgtcccccaagtcctggataaataggaggtgaaggagcctttgcaactggaccccactctgccagcgccaaggccctgcctgactacccaccccaccctacacagatcagggacctgtgccaaggtccagtgtcacaggagagtgaagacaaggaggtgcccatggcgtacatgctgctggactcactctgtagatcctaagggttatggggagttatctgccaggtgaggttttcccgtggctttttcctgcaggctcagggtagcatacagggaggtgcttccctactccttggcaccatctgtccggcttccctgagccctgaccctggctcctagatagccagtgtttcttcagggacagaacctgctttgctgctgctcagaggagacccagtttgaccagggctagcgttcctggaacctgagcctggaattccaccctgccctgggcagaggccacgttgctccctcctacgagagctgagctgcgcatgagattattctgaccttgggctctaccatttctttgcatgacatttgtcccaggctggagcagggctctgtggctcgcttggtgttccctccccagactgaggcctgatatgtacaccaggaagtgcttgatctggtttcaggagctgggagcggtttgccaggcagcctgtggtcagagcaggggccttaacaatggtcccttgtgcggcacattcctctctaaataggcccaggtccaggctgctcctgtttcgaccccgccatgggcctggaggggaaagtttgcatctggagggtggcccactgtggcctctttttgtgtagcagctgagaccgtaggtgcttgagaataggagaagccctgtgcccatcctgggctgtgagatgtttttccagaggtggggatggggatgggccagcatgcagttacccacaccctccagcttgttggcatcaaggtctgtgtatgtgtgtgtttttttttttttaattttgtttttccaacatggagtcttgccatttgcccaggctggtctcggactcctggctcaagcgatcctctagcctcaggttcccaaagtgctgggattataggtgtgagccaccatgcccagccagtaccaaggtgtgttttttaagagcaatattggccgggtgcagtggctcacgcctgtaatcgcagcactttgggaggccgaggcaggcggatcatgaggtcagcagattgagaccatcctggctaacacggtgaaatcgtgtctctactaaaaatacaaaaaaattagccagacgtggtggccgggcacctgtagtcccagctactcgggaggctgaggcaggagaatggcgtgaacctgggaggtggagcttgcggtgagccgagattgcgccactgcactccagtctgggcgacagagcgagactgtctcaaaaaaaaaaaaaaaaaagaacaatatcgatggttttattccctgaacatgctaagtgatccccatgtagtataagcatctcagaaggcaggaaaatgtaatgaacaacacccaccgccattcattccatccagagatcgttattttctgcccgggtgtgagtgtgtgtgtgcgtgcaaactgcacatgtgtgtatgaaatggaattaggatctttgtatacatcttgtgtcctgctatttttacttaatattctcggcatttctcatcttcaaaaatgtgattttaatgatggtgcaggcctttgacatatgggtttagaaaatctgcggaaacccggactgtttccaggttttgtcagtttaatgctgatgcaaatgtcctcgtacgtaaatctttctgtacttctgattatttccttgggataaattcccagaagtgggccaaagcacatgaacggtcttcaggcttttggagcaagttgagatcggtggggattggagaagggacccagggaggcttttgggagcttgcgagattggagtctggctttaggggacttgaattcacagatgaaggagatggctggcaaaggtgggaacctcctgctctatgggtgggggggtgacactgctttaccttccagtgacagcatggggatcctcccaacatgacctggctccgcatctttctgacactgtgcacggtccacagttgtgatgctcagctgggagcctcttctgtgtccttcagttgcattaactccttgcagacagaggaggaagctgtccggtgctcctccctgctgcgtgggtcctttgaatctgcccagttgggcctgtggatctgtgcagtcacgtacggggttctaaaatctgcaaaatgacaagctcacgaacactctcgcttctgtgggtgaatgtggataccccttggctgcgtctccctccacagggaagatggagacgtgtaaagtgacaaggacctgctacccctgggcaggttatgccggttccactgtgaggatggtggcagggggcttcccaggaggcctgcacattgggaagagaggggcgaccgtgtgtgactgcaggacccagggcgcagtcttaggactctgatgggggaggagatgctggggagccctgttctgccagcctggtgacagacatctcctaatgtttcccggctgggtacaactcacaatgtcctccgtggggaggcaattgcccatgaggcatccctggcagggatgatcttgtttcattgccacatatcccagcaatgaaacaagaatctagagtgatgtgattcctccgatgacttctccaaccatctggggtttttgtgcgactccaagaagggggaaggaggcagctctcgctcctctgggctcctgatgtggcagctctggaatggccacgtgtccgttggcccacagtgggccatttgtcgaatgtggttgtggtgggattggggctgggctggagagtgggtgaccacaccagctagcctcaccctgggccactgtgcagccaggggtttcatcttcccaggggtctcgttgtgagtgtcctggggctgctggaacaaattactggaaaccaagtggcccaacaaagattgattcgctcatggttctggaggccacaagtttgacatcaaggtattggcaggaccacactccctccgacagctcgaggggaggacccttccttgcctcctccagcttgcgttggcccaggcgctccttggctctggcagcatctgcagtctctgctctcatcacgtagccctccccaccgtgtctctttgtgtcccaagtccccttctgcctttctcctataaggacaccgagcactggatttagagcccatcccaaatccaggatagtctcatcccgggatccctaatcacatctgcaaagaccctttttccaaataaggtcacattcgtgggttcttggggttaggtattagacatgtctttttgggggtcactagtcaaccctctacagaacctcagacgaaagtgaatcttcacaggctgaaatgggggtgaaggtctagtgcgtccctcctccttgggagctccctcagggcttgtgcctatcctgtgatcctgtgatccagccttttttttgagatgaagtcttgctttgtcgcccaggctggagtactgtggcacgatctgggctcactgcaacctctgcctcccgaatttaagtgattcttctgcctcagccttccaagtagctgggattacaggcgcccacccccatgcctagctaattttttgtgtttttagtagagacagggttttaccatgttggccaggctggtttcgaactcctgacctcaggtgatccgcctgccttgggcctgccttggcctcccaaagtgctgggattacaggcatgagccaccacgcctggcatttagtaggttttggttgttttttttttttgagacagagtctcactctgtcatccaggctggagtgtagtggtgtgatcatggctcactgcagccttgatctcctggcctcaagtgatcctctcacctcagcctctcgagtagctgggattacaggcatatgccaccacccctggccaatttttgtattgtttagtggagtcggggctttgccatgttgcccaggtttgtcttgaactcctgggctcaagcgatctgtccaccttggcttcccaaagtgttggggttacaggcgtgagccaccacgcctggcttagtaggttttctagaagcgcctgaggcctggtgaaggcatggtgtcatggagtagagaacattcaactctgttcccggggagccggaacacacccctcgtagccaatctcaacagtcatgacgtggccaggatgacatggggagggggtggtgtggactgtgtgggaggccagctccccgggaagggggctggagtgggcttggctttgaggaggattcccaagaggaggaggaggcggtggcatgctcgtttggggggatggcgtgagccagggtgggcacctcttcatttaggtgtcaccttcttgacattccagccgggacatggtttccttggggaagatggacacccccagagtggggcatctcctggggaagatggacacctccggaatggggcgcctcctgttctcactgttcttctagcacacagttgtattctcttgcagttctggaggctgtgagatctcctggctgttatctagaacaaactcgcctttgagcagcgccgtcctgatggtggggtggcccctgcgggtggaacagcccctgctgtctcagagcttactgagagctagtgggcatgggagtggtgctggaccgaaacacccagagggatcatagagccaggcagtaagcacagaggccagctagtggggagggagggacccatccatgaaaagacaccaagcattgaaagagaggagaggatggttggggaccggcacacatgtgcattttgcgcagatggccaaggtggtgaggcgccagccacgcagacaactggaggaaggaggagtgccctaggggaggggccagctccggttctagaatgatccgcttgtgcacgtgggcctggctggaataaatcattgcatccgcaccgtagactcaatcgtaagctcacaccagggcagcctctgctttggtgcagtgtcttcgatcatgagttggccatggtgggggtgactccaaggggactcccaaggagggggttcaccggatctcccagggaaggtcatttgttttcttgggttggacctgggacaaggccttctcctgtctagtttctgttctccaacttgaccgcacggaaggatgctgaggacacctggaagccggcccctgctctacagcacccataggacagaggcacaccatgtggggacagtttggacagtgctcaggaggcagggagcagatcagaggaccgcgggaggccctgggaaccgcacgaggacccaggcattgagctctgcactttctggcatcagcccgatgtacagtctggctctgtgtctaccccgtacttcactttccccatctgtacgggggcggtaataatattctttacagcccaggtttaagcgggtgtagatgtgatgagcttggtaagcccatctcattacattcagttctgggcattgaaccctggactttctggctggtagaagtggacattcaacctttccttggggccctggggcttctgcagaatcagaacacagccagcagtttgcatgcagggtgcagagggacagagggacaccatgtcgggagcccacacctggcacacccctgactctggggctcagtgtcctgctgccctgcggccacgtgatcagctagaggtcatggctggacccataggcgaatacagcctgtggatttgattttgtttggccctgcggtgttttattttatttttagttttagtttgtggagacagagtctcgctctgtcagtcaggctgagtgcagtgacacgatctcagctctgcaacctctgcctcccgggttcaagcgattctcctgcctcagcctcctgagtagctgggactataggcgagtgtcaccatgcccagctaattttttatttttagtaaagatggggtttcaccacatcagccaggctgctcagtgttttaaaaagggcttgttttgctttgtgccagcatttaaagatcaggagatatcatataaagatccagatttctactctcttgagaagtgaacagctctggccacgccgggcccatatcctctagggcagtgacggagctgagacagggcctgtgacaactgagagttctctggagtccacacggctccttgcccagcttctggtggaggttgagcttagtgacccaggatttcgtctgtgtccaccaagaaggagaggtgcctgtggcttagagagggcgcccacaggagtgccttgcccaggaagctggcagctgaggcggccagggttagggggttgggcttcctcttcccctccccagtgcctgagtgcatttggaggaagagagacgggtgaggggaaggcactgaaattggtcctggagcgctattattgggggctggggaccagctgtcatcccttttcctgtgggcaggggaggcagtggtgggatcccatgagacccggactctgtggcctggtgaggcagggagcggctggggagacactgtgggtctccacaggggtgcgctgtgggtctggcctggggaaggagctggtgaatgtgcctgccatgtgggtccctccctgctctggccctgataaccaggagcggctggctctcatttggagtgcggttgtggggactgtggaggtggcagcttcccaggtaccatccccactgcctccgagggagcagaccctggtggagaggcaggatggctgcagggcgggagctggtggttggcatcactgcacgggcttgtagtagtggatgggaagatgcaggagaggctgatgactgagaaagttggttcctgtggactaagctgggggagccggacaaccaagtggttagaaccttgggctctggtatcagcctgatgtacagtctggctctgtgtctaccccgtgccccactttccccatctgtactgggggtactggtattctttacatcccagggttaagcggctgcagatgtgatgagctcggtaggcccggcgcctcgccggcactgaaagctccagtgtccgcccttagtgtcattgatggggttttgttcctgctgcggttctgattggttacagttgcggtcacttattattggaggcatgtcccccgctgtggctgatggtagaggtgtgtttgctggtggtgtcccagtgtgtgccttggctggaggtgaggagggataaaaacagccgcgacaagaaggaaatcaaggccgggcacggtggcgcacgcctgtaatcccagcactttgggaggccgaggcgggtggatcgcttgaggtcaggagtccgagaccagactgaccaacatggtgaaaccccatctctactaaaaatacaaaaattagccaggcatggtggcccgtgcctataatcccagctactggggaggctgaggtaggagaatcgcttgaacccgggaggtgccgctgcactccagccagggcaacagagcaagactccatctcaaaaaaaaaaagaaggaaataaaagtcttctctggaactagaacgttcctatgtagacgtagctggagggggaggctgtgtggtttgcgccgtggccatggcaagacacgacgggcagcatcttcccactccagcctgcatctctgccccagaactcatgatggttctcctaggatggggctgtcccttccgcttgctgagacatgaaggacgggaagagacccccggccctcaccgccgcatcgcctgccttcctctgctgctccttagcaggaaacatgccggagtgttccctagccatccattcaccaattgcatcccctctctttatttttcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagggtgagtcgcagagcgctaggtcttggatgctgtggtaatggggggcctggttgctggctttgccacagaatcttggaggaagaagctggatatggggtggagggtgctaccctggagacccagaaagaccggaatgcatgggggtgggggtctgcaagctcaggagaggtggctctctctgtctgatgggaacatgccaagatgccccaagcgggacttgaatgagagtttggaaagattttctgggtttcaaggagcctcctttatgggtcaccgtgggccttgctgggacctctgtctgctgtgtgtccctggagggcctgggaggcttagagaatgaggagccacgcaggaaccagggcaggctcatgcaggggtgtaggacagggtggagttgagacccctagaagggctgtcacattctggtggctcctgcttgaggaattgcaggctgcctggatatgcccagcagaggccgagggcttggggaagggaggagggacgtatgcctcctgaggcttgcattggagcccatggtctggtcctcctcccccaggagggatggttgtggcagagggaggggaacatgaggagcaccttagcctgcaggacaaaattctcagggcactgggaaggggtgcctggaccagggggctgtgtgatagctgcacacggttttatttgggggtgcccttctggcgagaggagagaggccatggggctccagcagcgtcctgggagggctcaagcccacagccgtgctgacatggagcttacaggcaggggattggtgccagtcctgtgggacacagggcctgtttggaaatgccaggctgtgggacatggttgggtcccttctcagaagcgtgccccctggccccagcagggatcgtggctccatggggctatagtaaggtgccagctgggttagaagcccctcaagagccaggtctgattctgggcacaggatcagaactcagtaatgctcagtaagccttctttaggttggacaaacagcacagtctgggtttttgatttagctgctgcttcttatttctaaccgtggtgaaatacacaacatacaatgtgcaattttagccactttgcagtgtacgtttcagcggcattcagtacattcacggtgttgcgcagctgccaccgctgtccatctccggtacccttttcatcctcccaaactgagctccgtccccgttagaccaagctccccatgcccctcccccagctgctggcagccaccattctattttctgtctttattatgaatttatttgaccactctaggaaccttgtgtgtgtggaaaaatacaataactgcccattttgtgtctggctcatttcactcagcatgacgtcctaaaggttcatccgtcgtgctgtagcatggggcagaatttccttcctttcagaggctgaataatattctgttgtgcgatgcacttgtgttgtgtagctgttcctccatcggtggacccttgggttgcttccacatctctctaagtccctctttccatcttctttgacttttctttgacttttttgagacagggtcttgctctgtcctccaggctggcgtgcagtggtgtgatcactgcttactgcaacctctgccccctgggctcaagtgattccccagcctcagcctcccaagtacctaggaccacaggttgcgcgccaccatgcctggctaatttttaaattttttttgtagagacaggttctcactaggttgcccaggctggtctcaaactcctgggttcaaatgagcctcctgcctcggcctcccaaagtgttgggattataggcatgagccacccaacccctttttggtttttctttttgaatgagagttctccagtggtcagtgggcttgggggctgggaggatgtggggcctggagagggtgtgggtttggggggagaccagtgctcctcatgctttcatgggcatgtggagtgcacatttgtcttggcgggtctggggcctgggactctgcatttcctacagagggggcatcggaacacactgagtagccagaggctagtgggccttggaaggtcctttccggccctcagtgtgcgagtcccgtgttccctctcccatctctctaagcttgactctgaagagccaccctgccccagccacccagactcagtgacagtggttgctggtggcatggtgtcaggccaaaggcatgggcagtttgcagagtggcaggaggctgtttcctcccctgccttctgttggtgcaggacctttgtttgacgtgccggatacacccccatcctgggttgatgtgttcacactcagctgagtcaaacaggatgtggctggggaggcggttgtcaccgagccatctaaatctcggtgatggctggtgctggatgcacagggacgtggtcctggctctgggggacaggtagggggatgtccatggggatgtacaagaacattctcctccaggggcagacacagtttagcccctaaattgtgccagagactgtgccgggagccaggcccagggacacaacctgcgggctctgctttctggagctcaccgagccgtgagcaggatggctgggacacaaggagtgtccagggagcttccccagcagtggaagtacaatttcatcaggccaggaaggggagagaaaggcaggccacgtggaggcagcagcgttcagagctgccaggaacctggcgctctggggggacggtggctttctccatggaataggatgtacacgttggagccggggcatgggagaaaaccatcagcatcccagacccggccacccacggacagggacctgtgcaggtgggagtccagctcacgtggagaggtccgtgggctgggctgacagtcctgagggcctaagcaagtccaggtggaggaaatgcagggacagacgagggcagggccttcccaatggaggagtgctcttgaaatccgatgggagtggcttctcggggggcccaggcctgagccccactagttcttcctccgaggcaccacctgcttgcttctccgtcctccctctctgtgtcacgaccgttctggacacggatccagttctctccaactcagcttcctgcccatctttccttcaggcccatccccttctgcccctccatgtggggctgggctgggagttccctgagccccgacatgcacagctctgaccaatctctgcggcccctctgtcccccgagcaccagggatccagctggcaccatggggaaaggaatcatggagggagttccgtgccctctgagcagacgcccagccccttggcttctgcctgcgggagggcatctgtgctgtggtttgtctccaccccagagctgtgggtgcagggcagggtctcctggggccccagctgaattgctcccagactgacttccccaaagcacagcactgctgagatctcttcccgtgctgagccttctctgctcactcaccataggcccctccacggttgattcactctcctgctcagctcacacctctctccttcccagcttctcctgctttggtcttcccttggtctctcacacctttcctcacaacccctttgccctgacctcctgaaccctgacctctgcttctctttacatcactgccttggtgaactcctatgcatccctcaaaacctggtccaaatacctcgtgtttggcttgggatataaatgatttgtgtataaactttctttcctctgctagacttttttttttaaatgtgaaagtagtttttcagatcataaaaagtaatcgagtaccctttctttaaaatgcaggaagtacagaaatgagaaagaacctaaaattcacctgtaagccagcgatatccatgcttgaggttttgctgtatagtcttcaaaattcctttcatgcccccactagattctgagggtagggctgttgtctttgtttttttttgtgttttttttttgttttttgttttttgagatggagtctctctctatcacccaggctggagtgcagtggcatgatctcagcttactgcaacctctgcctcccaggttcaagcgattcttctgcctcagcctcccgagtagctgggactataggcgtgggctaccacgcctggctaacttttgtatttttagtagagacggggtttcaccatataggccaggctggtctcgaactcctgacctcgtgacccacccacctcagcttccctgacctcccaaagtgctgggatcatgccaccgtgcccagcctgtcttggtttttataaagaatcccataaggggccaggtgcagtggctcatgcctgtaaatccagcactttggaggccgaagcaggcagattgcttgagcccaggagtttgggactagcctgggcaacatagagaaaccctatctttacaaaaaatacaaaaaattagccaggcatgatagcatgcgcttgtagtcccagctactggggaggttgaggtgggaggaccacctaagcatgggaggttgaggctgcggtgagctgagattgtgccactgcactccagcctaggagacagagtgagaccctgtctcaaaaaaaaaaaaaaaaaaaaaaaaaatcccataagataccaagtaagtgacttggacataataggtgtgccatgaaattatgctgaaggagtgagccactggtggtgagttgggatggcttttttgtggttcttgtaggcagatgtagtgacccccatgggtcgtccctagagaccaagcagaaactttcctggtcaactttacccccaggacacctggtctctcctctggaggttgtgctggagggctcagtgggtgggtgttggcttcagtgtgggggttctggaaggagtcagcatttcaggagggagtgtgggcacctagatggttgaaggggagggagaggaagagaggcgctgcagagggcagaggcatccctgcctgctcctccgccccagggcctggtgaggtctgagctttatgctggtggggtggattctcggtttccgaggctctggccctgcccctggacttggcaccctccttgctgtcctcccacagaagggcgctcatcctttggggtcatccctggtcctctcaggctctgggtggggacggccttgcctcctctcctggatccctgctcttttcctgccccccaacatgggtgcctctgggtggagtggggtggggctgggctgcagcacccagtactgagcctgcaagggctggctgctggctcagagccccccccaccagagttacccccctccggctcctcagccacaccagccaagtttctccagagctgccttataaggcgggtgctcagcgctcgttcatgggtctggttctctgccttcttgggatgctcactgggggcaagagggaggccaggcccagtgcccagctcagttctgggcatgtcccagctctgccccatgagtcaactggttctgaactatcattccacccctcccagcctcaatttcttgatctgtcaaagaggcatctgcagaggtggctgggggctgagctctcatgtatccacccaccccaagaaccaagaagggagtccacagtggttctggggccacttgtgaacatggatgtgaaattggggcggggtagacatggcagcatgtctcagtagttttcctgtgacccagagggtctggaaatctttgtcatgtgggtggagcgttgagggagcagggggtcaggcccccccgagctgatgatggtgggcgtggctcttcgcatacttggtccgcaccgggccgtgtgttccaggggcagaacagggaggaatctcagcacagacagcagggctgccagtacagcgttgagtatagggttaatcaaagcacagggctccctggaaccacccaacacagagcagtgaagaggtggctttggggaaagtggggtcagagctgagcctgagtggggggtggggagggcgggcatcagcctgcaagggagggacacctactgggccccagaagttcctggtggggatcagggactgtgaagttggggagagggtgaccactgtgatttagggaggaagggccccatagacagcccagcttctggccccgtgtttacaggacaccccacataggctctgagcctatccctggactgtggactccctgaggcagggtgtgcaggttcgtccagtaccaggtgtaaggcagggggccttggtaagcgtcgagggactcactggtgtctgatgaagcagtgagtttggatcgtgtcatgcctcgggtcctgagcctgcaggatttttctgtggggctgtgtgcttctgcttctggaggtgtccagaaggcactgacgttcctgccgggatgccttactcggaaggtcccgctgctcccacctcctcccattttcctgagctgcttgcagagggcacccaggtccccttttactttgggattgggtctctttctctttccccttctaagaacaagtaccctccttctccgaactgtccctggagcctctcagacctaggtctagagtgggaagtcccgcatgtgctgggggaacaggaatcaatgcgggaggattggccaggcccggtgtgtctccttcgtggtgggacggggtggggccagagaacagagcctggctccagagcccaggaagagaacccctcccctcgccggcctgccaagcaccgtgcagtggtgagaggaaaggagggctggtccgggaatgcagcgggtgccgagcagctgtggaataccttaaatagagcgcagctgcggggaagggtggggccaggaggcaggcgctgggggcggtttctctgctccgccccctgcagctctgtggccctgaccacccagcctggccccaggatggagccccggcccccagacacatggcactgggtgaggccgcctctcagcacttgtcccaggaagtcagagcagctgccagaagagagaggagctgtgtctgtacccgccgcctcccaggcccgggacagctgccgggattgagggtctgcacaatggcgagcctgtccggaggggcgcgccgcggccagacagccatgctctgtgcggtgtggacagagggcacattcagccctggaggagcgcactcagactccccgcctcggggcccaaagtgtgggcagcccctaaccagaccctggattccagcagacagcctgggaggatgccatgtggtccaccctgacacactgtctcacctgtgacctcatttctgagagctgcagggaggcgcttcctcagttggactccacttcctctccggggttttctgtgggtgttataagtgactctgtctccttcagtccaaggggggctcctggggtatgggctgtaactgacaggctagagtagcccatggccagggctgagcttccttcccgttctctctgaacactgggcccaggaaggggttaaagtggagatgctctgattaaagttgagggaggcatggagctcccctgaccctgtccccccatcccactgctgctactgggtgtactctgtggagccccaggactcttaaagaacccagagtggagattcccggtctcatccagtgcaggtgagggggaaagtgatttgtccacagttacatggctaccatcagcacacctgggtcaagctcgattccactccacggcccctgtctgaaacctggaactggaaatggccctggaaatcactgattccatctgccgccttccaaaatggcccgcagaggttaagatatagactcctgtaatgccttgcccactcgtgtgtggggaaatggcagaggagcaccggctttgccctcacactgcctgggctgccgcccctgccctgcctagtggctttcctctctggtccgttttctcattgtggaagtgggcacaattcttcctgtgcagcgtggttagagtggacagtgatgattcgtgaagcagggtggagcgcctgggggattcgtgttaaacaagcacataaacaaaagccaacacaacccttacttaatcagcaagcaggccttgtctgaagcccctgggcagcacctcatgccatccctaggttccaggccggtggtgtcgccccgtgtctctctcacccgcaagctggtgtttagaagccctgctctgtgttctggctcccattctccctgtgacctttccctttcttcatcctaaaaagcaatgcacgacggggcgtggtggcgggcacctgtagtcccagctgcttgggaggctgaggcaggagaatcacttgaacccaggaggcggaggttgcagtgagctgagattgtgccagtgcagtccagcctgggcaacagaacaagactcccatctgggaaaaaaaaaaaaaagcgatgcccagtcattcttagatagaaaatgaagatcacatgaaatttggaaagaagtttttctctcccattccccaactctctcccaaggggtggccatgttgacagctgggtgtggcattctcctgaattttattcctgcagagtcattcagggcttgtgtaaaaaaagtcaatgtgtaaatatagacttttcaagaacacaaaggaaatcagacttctgctaccagcttttattttttccatttaacaacactgttgccacttgtagatgtagcacgttcctttttctttttctttttttttttttttgacagagcgtggcccaggctggagtgcagtggtgcgatctcagctcactgtggctcactgtaacctccacctttcgccttccgctttcaagcgattctcctgcctcagcctcccaagtagctgaaatcacaggtgcttgccaccacacctggctaatttttgtatttttagtagagacggggtttcaccatgttggccaggctgctcttgaactcctgaccttgagatccgcccacctcggcctcccaaagtagcacgttccttttaatggttgtgtcatcagctgtcccatggccctgccaggcttgtccagcttcccactgtgattgagaggctgcaacagatgttctcgcacttgtacatgtgcacacatgactgaaggatgagctcttagtgaatttctgtgtcaaggatgtgtgcatttaagttttgatctgctgggcacagtggctcacacctgtaatcccagcactttgggaggccaaggcgggctgatcacttgaggtcaggagttcaagaccagcctggccaacatggtgaaaccccatctctactaaaaatacaaaaattagctgggcatggtggcttgtgcctgtagtcccagttactcaggaggctaaggcaggagacttgcttgaacccagcaggcagaggttgcagtgagccaagatcgtgccattgcactccagcctgggtgacagagcgagactccctatcaaaaaaaaaaaaaaaaaaaaaaaattgatccttgttcctgaattggcctctaaagtggttactagaattttttaggacccctcccctcgtcgacctgctcagctgtctgctgggccctgtgcagtgatggtccagcagggaggtcctatgccccttacccctggctgagggccaaatgctctccaattggtgttttattttgtgcatctcggtcaagcgagagggattatctcttcgtatgttataggccagggccctgtgttctcttttcatttggaaggtgtatccttttcttgttgaaattttttaaaaagagttctttgtaagccaggcgtgatggctaacacctataatcccagcactttgggaggctgaagtgggcggattgcttgagcttaggagttcgagaccagcctaggcaacatggcaaaaccgcatctctgcaaaaattagctgggtgaggtggtgcgcctgtagtcccggctactcgggaggctgatgtgggaggatcatttgagtctgggagtttgaggctgctgtgagctgtggtcataccactgcactccagcctgggtgacagagtgagatcctgtctaaaaaaaaaaaagagttatttgtacatctttatcacagcaggtacgagtatcttgtccccagctgcctacttttgattttgtttctgggatgttcttctacacagaacattttaatcctgatattgtcaagtctctgctttcccttttagcttttggaattcacatcctgtttagaggtctcctgcgttctgaaattataggaaagaatttcacccacgttttcttctagtacttctgtggtttcatttttacatgttgaaatcatgaatccattggaatgtattttggtttcagcagcgaggtaggggtagatggtattgcttggatacacagcagcgagcttggtctggagcgggtggggcgtgtgtgtgtgtgtgtgtgtgtgtgtgtgtgtgtgctatttttatcagttttggtgtctgcattgtgctggcttagcaaaaacaatttggatgcatttcttttaccctctgccttctggaacattttaagcagcaacataataatctctctgttaaaacttttcaagaattcactcgtgaaaccatctgagcctgatacttttgggggagtctagcactttaaaaacttaaactttttccatgggtctgtgagtttgggagtttttctttcttcttaaaattcattactatttttttcctagaaaagtgtcttttagcttatttaaaatccgtcagcttattccgagggggttgctttagctcgcttagtgaggacagtgtgcagcgcggtgattgacatgattgatcagcagagcacgatcgatcagtcggtgtgcaaacatgactgactgtggccagcgtcctgggatgctccatgttgaggcacatgtgtgcagtgcagggtgatgtgtattctgagaggggatgaagccacaggacccctgcacccttaggagagagcccccctccccaaggctgcagtcttgagtaggtagtgacgggactgggtctagggggctgagtggtcccagcaggccaagggcttcaggaattatgagaagtttggagttgcccagagagcagctttcaaaaccagtctggactgcagcctccagaaagacatgcgattgacaccacgaaccaggacacacctatatatggggtgggggtggggatgggatgtattaatgaaaccaaatttccgtgatggaattcttacctttaccatgcgtgtgctacactcagtattttctttttttttttttttttcccctctctctttttttctttttgtttgtttgttttggagagagggaaggctttttttcatttttttttaaacagctttattgagatccaagtaagctactatacaatccaccaatttatttatttatttatttttttgagacggagtttcactcttgtcgcctaggctggagtgcagtggcgccatctcggctgactgcaacctccgcctcctgggttcaaccaattctcctgcctcagcctcccgagtagctgagattacagacatgtaccactacgcccggctaattttgtatttttagtagagacggggtttctccatgttgaggctggtctcgaactcctgacctcaggtgatccacccgcctcagcctcccaaagtgctgggattacaggcatgagtcaccgcgtggcccaatccacccatttaaagtgcataattccatggttttcagtctattcagagagtagtgcaaccatcgtcaccacaaccaattttagaaaattgaaaatttgagaaatttagaaaatttttttcttaagaagaaaccccgtagcctttagctatcaatcctgccctcctcctccatatttccttcctatctgtgtggattctttttttttttttttttttttttgagatagggtctcactctgtcacccaggctggggtgcaatggctcaatctctgctcactgcaacctccacctcccaggctcaagccatcctcccaccatggcctcccgagtagctgagactacaggcctgtgccaccatgcccggctaatttttgtattttttgtagagatggggtttcaccatgttgcccaggctggtcttgaactcctgggctcaaatgatcctcctgccttggcctcccaaagttctggaattacaggcgtgagctactgcgcctggccgattctagacatttcttgtacagagaattgcacgtttggcctttgtgtctggcttctccacttggtgtcatgtttccaaggtccatccacattgtggcaggtgccagtgcgtccctgagtaatattccaccatggcatggaccattccattgtggacagacatgttgccttcatcagctgagggacattgggttgctgccaccgctggtgagtgtattcttttcaaattaaaaaaaaaatgctggtcaccacccactagatcgttttcttggcccacagggtgggacaagccggcctgggtgagggccaggaggtggccaggtggaggcggctggagcggccctgggttgcctctgggcgcagcaggcagaggtgcaatggcagagtctgagcaggttccctgggcggatctccatgccggtaatgtttgtttattcaagaagtctcggccaggcgtggtgcctcacacctgtaatcccagcactttgggaagttgaggcaggcagatcacctgaggtcaggagttcgagaccagcctggccaacatggcaaaaccccgtctctactaaaaatataaaaattagctgggtgtggtggcgtgtacctgtagtcccagctactcggtaggctgaggcaggagaatctgcttgattccaggaggcagagcttgaacctaggaggtggaggttgcagtgagccaaaattgcgccactgcactccagcctgggtgacagagtgagactatgtctcaaaaaaaaaaaaaaaaagaaaaaaaaagaaatctccagtgctgccctgtgcccggcaccgaagccgagggaaggcagcattagtatgagctcccagcccaccgggctcctgtctggagctgacgtgcgaccaaggcacacgagggaagcatggcgaggtggacggtgcggaggcataaggagcaaaataaggcagatgcagtggctcagtggctcctggtggctgcgaggagcgtgggcaggacagccccaggagggcacctggagagcagggccggctggggcaaggtgtgtcaggcacttgtcaggagcaaaatgtaaggggacaccaaagagctcaggaatcaacacagatagtatttaatgcagtatttttcaatatcgaaatgatgcatagtaatctctatgatgaacaaatgttggaattttaaattaagacaggcccagccctgcacgtgcacagccctgtcagagtttgttcagcgtggaatttgatttgtttaaaatgttgcttcaaaatattgtttgattcctggattttttggcactgccttaacttttgcacctggacgaaggcctcaccctaatcccagctggagagggtcaagggctggtgaatttggctttggacctgcagagcttgtggtacctgagaggtggggccaggaacaggaaggagctggtgagaacggcacccggtatgggatggggccagatcagagcagcactgtggctctttccaacccgtggttttgctgctggatgcttggcgttggtgctgagcccccggccctctgaacggagtgtgatgaataacggggccggggagctcttgggcccctccctgaagcagcagtgaagccagggacatgccggcagcaggcagggagagggacgtctggtctgtgcctggagccagctgccccatggaggagctgggtgaggatgcggtgggaggaagaccttcccagtcctgcatcctccgaagcataactgagtgcttgtgtggcttgggggtcactctggtccgaggacagtcttgctttgcttagccaggctttgaagagccaccgggatacggacagcagccctgctgggtggcaggttgtccaccctcgcccactcaacgctggaactggatgcagagcacctggatggccagtcccagagtgtctctgacactcccagtcacctcatcccttagaccaggataagatgcgggatcccaacctcgagcctcccatgggctccattccatgtgctcccataagccactgggcccacctcctggctccagggctgtctggccatttggcatcttggtttcctcatctgtacaatgaaaataatagtcccagccttctcgaggagttacaagatgcctttcgtgtgaaaaactgggatttggtaccagactatctggatttgaattttggccctacccctcctaacctgtggctttgggccaatctggcctccctgtcctcagtttccccatttatagagccatctcattgagttgctgggaggatgaacataaggaagtgtactcatgtgcccagagcattgtgattttacttattattaccaaacgaggcacacaataagtgcctaatagatgctcagtgtcatttcacggattctgtgtgccttgtgtgtctccagcagccaagctctggaggtggggaagctgttgacgagttgcacgaggtaattagaaagaggaggccacaggtgcaagggtttgggtgacacctgtggacagagagaggccgatggaccctggcagaggggaagggggcccttgcacatagaaaatgtttcctgcatccaagatccttgtgactctggaacagaggcagcagaggtctgcaaattccaaatcataaacccagaaagcatagaacattcgtagagaggaccagaaacatcatatatcttagtgtgtatagaattttccacatagccaaacaaaagcacgtttctaactgaagctgttggagagttcctgaggactttataccagacaagggccggtaagtggaagttcaatacgcaggagccattccttttgttcacaaatgtttgccgtcttttctgtctatatccgcattcatgtgagggcactcataggtccaccgtccagccccatgctttgtttgctaccaaaaaatttcttaagaattcctcagctgcaaatcctcctaccggagggggggttccaggaacccagccttgctcggggttggggcacctcagcacctgctgcacaggcgttggtcattaaaggtcatgtgccgtatccgtgggccctcggggtctggtggcacctgggcacacagtccagtggcggcctcctacctgccagacactgggagtggggggctcctcattcctgttccctggcggtggggggagtgccccgagctgtcacacatcagaacccaccgactcacacgttgcggcaccttacagccccttgacagcctctcagcctgagagaccatcaaactgagttcctggagagggtggctgttgaggcctggacacaggtgtggacaggatagccctgcctcatctcggagtcccgctccggttcagcctcttgtgggtctgaagctcaggctgggccagtccctgcccctcagatggccggaaaggcagcccagccccacggcctccttgtcaggctctgagagccgcctggcctccagctctgctctttttttttcttaagatggagttttactctgttgcccaggctggagtgcagtggtgccatcttggctcactgcaatctccacctcctgggttcaagcaattctcctgcctcagcctcctgagtagctgggactacaggcgcgtgtcaccatggcaggctagtttttgtatttttagcagggaccggttttcaccatgttggccaggctggtcttgaactcctgacctcaagtgatctgcccacctcggcttcccaaagtgctgggattacaggtgtgagccgccacgcccagcctccagctctgccttgattttctcttaaggccgtgaggatgtccacgcctcctcctttcctcacggcccattgatgtctccagatgctctgcaaagccaccctcccctcgggagctccccagctggtgacgggggaccttttggggatcactgcccaggtagtcatgtaggtctgtgggccgtgcttccaggctggaccgagacccggtgcatggggtgcttctggtctgagctgaggcccctggaagccacagccaggaggcagcaagggacggctgtcatgtcccctctcccctgtctcccagggtccctgcgggacagatttccctgcctgagcctcctggttgcccataccctggcctcccaaagcccagcctgaagccttaggcaccctacaacctgcttcctctagcagcctgccctgtctcttctctgccgatgttcctgaaactttcctgcctctccttacctcttggccagagagagactggagaccctgtgggaacccccgaggggagggagaaggccgctgtttgaacggaggtggtctttccctctgcccctccccaggcgggtcacacttgcaggcccagcctcctgctgtggcagcgcttggggtgtcggctgcctcctgggcacgagttgggagctgagggaggcgctttcaggaccggagtggcaacccagctggaggaggagtaacaggcccgtggtcagcagcagccgccgcagggaccccggcgctgtacctgtgccccagctgacccctcccgcttccctagggtgggccggggatggtggtctgttgcccagcccaggaagaagaggggccgtaatcagcagcagccacctcaggggaccccagcgctgtacctgcgacccagctgacccctcccccttccccagggctggctgggaatggtggtctgttgcccagcctaggaggaagaggggctgtggcttccactctagaggtctctctcccggtccctcccccggtgctggtctaactgcaggcctgccttaggccgtgccggcacctgctgactgacgcttagcggatgctgataggagagggctgggatggggaagcagcaagtcccggtcactgtgggctcgggttacagatggttgaggcacctcctggccatccccaggaagcaaggccccacgcagcctccgactcacccactgcccgtgtgtatttcaggaggctgcatcccccaaggcccccaccaggtaacttcattgggctgggtgtcgctgcaaaaccacccattgggtgcggtggtcttctggtggggggcatggctggggaggatgcggtggaggagaagccagctccgtggttggggggagggcggactatccgtttcctgtctgtcccctgaactggagctcatggtccctcccccaggtgcctgggccatggaagaggtcacagccctgccttattcctgtggcagcctaggggagccctggccagtcccgtgtctcctgggagggcgacagcctggtcaggctgcagggcaggactggaatgcagacccctgcttggccatgctgttgcctggctgctctgtctggggaccttctgttcaggaagagagaagcgggccggacagcccggctcagtgattggaagctcagctccccatgttcagtccagcaggaagtttgcctcctcggaacacttgcgtgcttctgcatgtgtcttcttggctggtggttctgcgaggcccctactgggctgcgtcatgtcctctggccaccctggccttggtgcctggcccctgtgaaacagagatacctgggcagtcccccacttgtgcttgcaagcctgtgtggcttcagtgatggctgattctgctccacccagaggacctgggaatcctcagcccaactgtccagaggagtctttctcagtggggagagcctgagctgtcctcctggtggacagtcctttagatctcaggcggacttccctgccggccgttcctcctgctgcccctgctcctctgtcccccatctgtctcccaccctctcccctgcagcagccagctggcacggggacctccccttccctctgggattgtgaatgagacgactttcctggtccttctgggtctagatctttctggcaacagtcagtgaaacccttgtctcaggtgggaggagaaggctcagtatgtggtcacaacaacggtcctaaccacatcactctcaaacgctggctttcacttaccccttgccctgcccaacagttactttcatcatcccattttccagattaggaaatcaaggcgcagagagcttcagccacttgcctgaggcccccacagttaagtgtctggatttgaaccctggagcagcctggctgctgagctgtcctggagacggggtactgtgcagtggtcggggtaggggtggagctctgccgtcgctgactcccgggctacctggagtgataacacagcccagtgtctgggcccctgcctgagactttggctggatgccaggagcccgagaccttccagctctttcctgtgtaaggcgccatggggtgaaatgaaagaaaaccccagttagaaggtgtccccctcttccttcagtccctcagctgccctggattttgaaataagacaccgcccgtctgtggggtgagcaggaacagattggaaccgcatttctctccccccagtcacagctgccaggagctcatctttctctgtctcctccccctgccgcctctccccacaagactgggctggatgctgctgggaaagtcaacaggaagtcttttggctgcggtggaggtgggggtctgtgcttccctggggaccgagatgagggctccaggttggctccggcaagagcagggaggctcacgtctctgcctgctggttttgcttcctgtcctgggagaaggtatccacatgtcccagaatgcaccctctgcgtgtacagggatggcttttgggccattcacctgaggtttattgatctttctctttggaactggagtggctcctccacggtggattgggctgagctctctgcctcggccgacgtctttccccaggcacttcctctcaccgtgccagggtgcaggttgctagtggatgggtcttcaccctcggggattggcagctgccacgctcatttcacagtcgagacaccctggccgaaggttctgctaagctccatggagtgtagggattttttttgagacggtctctctctgtcgcccaggctggagttcaatggcccaatgtcccgctcactgtgatctcgacctcctaggctcagcagtcctcccatctcagcctaccaagtagctgggactacaggtgtgtgccaccatgcctggttaattttttaattttaatttttttttgtagaaatggagtcttactatatttcccaggctgaactccaactcctgggcttaaatgatcctcctgccttggcctgccaaagtgctgggattccaggcatgagccattgtgctcagctggggttttcctttaacccttcctggcccttcccaggtgcaggacccgggcctcagccttatgtgttcttgaacagctctgggctctgtcctgtacctcctgggcgcgtggtcaggcctctcgtgacatcagcaggagactcaggtgaagaagcaggcagaacggaatgcttgctcacccagcctcggggccaggcggggcggccaggacagtagcagtggctggtgtggcttcctgggaggtcagcccattggcgtggccagcgaatggggaggggagcttctccccttgtctcccctcatttctggtctctgggcctccagggccaggtctccagagttctaggtggaggatggaggtcagggaagctggggtaagagcgggctgggggtgggtggtcaggcggatcctggaaaaccatcctctgcaggtcccgctttccccagggagcactcagggctggtcccggggagccgggctaatggtcacctcggatggtgcaggggtccatccccatgaaaccgggcccatccccatgaaactgggcccacagaagcttttggttccggttctgttctgccccctggctcttgcttccaaagtaggactcaggatagctctgaattccctgccgaaatgcagcttcctgggccctaacccagccctccagaaccagagtctctggggtgggccctctgcttgtctagcagcctccaggggacacttgtgcctgccagagcaagtctaataagcactgctgtaaacccctcgtccccacagccttctggttcgtctcccttttcctgctgggatctgcatcaggattaaatgccaacatcagggatcaggttatacttgtgaaccctgagacaatacctgcatctttttttttcttgaggctgtcttgctcgctctgtcatccaggctgaagtacaatggtgtgatatccactcatggcaacctccacctccagggttcaagcaattctcctgtctcagcctcctgagtagctgggactacaggctcacaccaccacacctggctaatttttgtatttttagtagagatggagtttcaccatgttggccaggctggtctcgaactcctggcctcaagcgatccgcccgcctcagcctcccaaagtgctgggactacaggcgtgagccactgcgcccggcctgatacctatatcttgaccaagctgctgtggaaacattgagttccccttgatagttttgtccacagagtgaatgtttaggaaccggcgaggcatctctcacccccacccagatggcggcctggaggcagcgtttctgaccctgtgatgggatttgtctctcttgtccaagagactttagagatgtggcccctgaatgtgggggcccctgttggggtgggaacgggagctggccctggccattgtccagtgaccccatctcagtgcctcgatcctagcaccctcgatctcagcgcctccccttccccggctccgcgcggagatcacgtggcttgcgctgagcaatcctccactgcccccgtcgcgttcctgctgcagggaagcctttccagggagccagctgacacatttggcctccattatttgtttttgaacaggaatgaaaggagagagtgagtaagaaagtggcaggaggtgggggttgcagagtaggggaaggtcagagagaggggaggaaagatctggaaagtccaggcatgtgctctggaagcaggtgccagcgatgagctcatctggagggtggccgcccgccctgagccctgcctggggccagcagggaacactctgccagggcatgtcgctgggagcctgtccttggctcactttctgctgctttgagcgctgagcagatttgtttccattttagggacaacgcaaggaggctgtcattccacccctcaccttattaatatttcatgaatcataagtgaccacttactgcgtcctgacgtactccaggcgctgggctcgaagctttatgcgcttcatgggatgtatctgcactatcgccgtagaaaacggttcctgttactactgcagagaaggcaccgaggcacagagaggttgaggaactggcctcaggccacacagctagaagcggctgaccctggctgtgaacacagggctgcttgactccaaagcctgagctggtttgcagcgaggctcatggtttctgtgccactgtttgagcctctggtcgagccccttggctcagtggggggcccagtgacctaccagctgttccattatatgttgtggacacctccacggcccacctgggtgggagggaaggggcttcaggaggtgggaggggtacagggaacacagtccagcctgcttgggcccaataccttgaccttcaaggtaccccttgagggtagcatgaggctaagctcttgttctcctccaggactctgttcctgtgagggcctcggggtcccttgcttttttctgggggccttgctggtcaggatcacagagaagctctttgctgttgatctttctgcctctgtatcttttggcaagccattttatgactcagttgctttgtctgtaaaatgggttgaataacattgtcctgcctcggagggtttttgggaggatcaaatgagacctgttgcacagaagccctttgtaagccatgctgactggcggtcgccgggcccccaagtgaatgggcatccgggcactgagtgtgtggactcagtactcggaaggaggggctggggggtacctagaactcctgggaggcttggacccctgctctgctcagattctgagcttctccttggccagtttaattcccatcagtagggtgagggtaaccaggacttacgcatagttgggcgaagtcgagtgaccacatgtggaagtctagcgtccttcatgcaaagtgggcaggcggccaaagtgagctctgctccagtccccccacccccggggctgttcctggcgccctgccctcccccagagccccactgacctgcaccatgtgacccgggcctgggaagatgggcccagctgtgggaggtcgtgcgggctggggactgagagtgccggaggagggcctcccaggaaaacccagctgcacaggaagccgggccagcggcctccggaagcctctgggctttgcaagctggactccccagatctgtggctgtggggccctctcctgcctgcagctgagagcccttgacccgcacctgagggcttcagaggtccgggagggggatgtgaccgtgtccccagggtgaagcccacccgagtgtcactctggatacagccctcacctcttcctggccccctctctggtcatggggacgctgcctggggggggttcccttacatggaaggagctgcagctgagctggcgggcctcgcacacccccaaggccgcctgacttccagcctccaagtggggttgcattcaccactcaggacctggagcctcagccagagagggaccctccactgcctctttctctgtctcttgggaaaggtagggtctttgtgccccctcccacccagggacctggcatgttgggaggctaagaggaagctgccccccgctcatctaccccccaaccctcccagccagcagagttttacctgtgtgcttagaatctgtgcgtggagccagaagtcacaaggttggcccagctgtgtctgaccctggttgtgcggtcttggacagtcccagccctcctggagctgagcatcctgatctgtagaggagaggctgctgtgccggccccgcagggccctgtgcagaggggagtgtgtgcggctgtgagttcaggccatgccctcagactggaggataggatcggaacagtgggtcaggatggccagagggtcccagcctcaggaggaggcctccacacctcccagcacctccacaccaggaaatgcagccaggcccccaggcctcccatgtcaggaagcagcaccccgccccccacctctggttgcctgggcctgagaagttgagcactcctcccgaatccgagtgccctctgacccctgcttgggtagttgtccctcctgaactgaccgcctgtcctacacagtcccctgtggtttgcccgacagggtggccagcgagtcccctgcacagcacacctcccccaggagtgctgcctgtgatgatggtgtaaagggtgcccccccgagcccccggaggcatgcagtggcgcaacagcgtgagcccaggagccccggtgagctcctggatggagaatctgttcagatcactccccagcctaaaccttccctgggtgtctgctgtgcttggggcgctgactcatcgtggggcggcctgtgagaccctacgtcacctggccactcccctcagcccctgttcactgcaccggtcccctggcctggctgctcctggaacatgagggctcatcctcacggaagaatattcacttgttccctcctggaaagtccctccctagacctcctggccgcctcattcaggtcttgctgaagcgctgccatcttggagaggcctccctgtcacccgcagttaaaacagccctcccatgcctgtgggtggctttctatggggcatggatgagtattggagagtcttgccgtttatttgttcatatgccctctgggagggcaggggacactgacttgtgttgtgggtgccttgcatgtcacgggtgctcagtgaatgcctgttaagcattaggggagcacaaaggagggaagcctctgtccaactggagcagtcagggaagacttcctggaggaagtggtatctggtctgcttagaatgtggcgatttgtctgtatgcagacattagattagagggcaaaggccattatcataacttagcagacagctacaagcagctaaggaattgctatgacatggactgctcgtgattggagctaagaaggagtcagagacagaggtccctgtgctctggcgtgagtccttgggggaggctgagctcccagaatgtggggccgcctgtgcagaggccggaggtgggagacacacctgtgagtgccggtgagtgtggggtgagccactggggctggatcagaagatgggaatccctaaacccaccaaccagccttggtgccctgggagtgacaggagacggggcttctgggggactaacccagcacaagtggacgagatgggatgcaggggaaaggacaaagctctctgaggctttgggaagctgagttagggtagagccatgacagggtgagttccagaagcaacacaagaaaaaatagctagactgggttttcccttcactgtgggagatgccccacctcacttcccccgtcctccgggctctggcaatgggctgggcacagtgaatgggttccatctgcaggagtggtcacaccccttgggcacagctgcctcatacactgtattgagatgggatccgaggccgggaagaacagcttcttctgtaggttgacattgtcagccttcggggagggaaggacggcagggggcctggagcatctccttttgccatccacactctgtgcctgcctgcagggtcttgagccctgtctgttctgcctcagtcctggtcaggaacttgttggagcccataggggcagtcaggctggaacaggaggagaccaggccggcaggggagccgagagggggccctggacagcacccagggctgagtcatcctgggcctgcccgacttgctatttggagctgttcccgcttgctcatcatgtgcaaggtcctgatccactcgggtctgtttaaccagcgcccctccccaggcccagttagcctggttttcgttcgattcatttattgtcatcagtgccatccttgcaccacgtaactagcctttgcagcatgccagccaccaagctcagggccctctgtgcatctcctgtaaccctcacagcaacccgggaggcacagagaggctgagtcgctggcccatagtcacacagcaggtatggggcattgccaggatttagccggatctctgactccagggcctttccagggccttgggtgggacactggcaaggaagcaaggtatgaacactggccctgccttggacagagctcggggacggtggcctggcaggcccagctgacacagtgaccctggtgcaggttcaaccattggcaaagtgttcaagtacacacagaatctcaactggggagacaggcgaagcggtcaagggagggctgtgagtgacaggtggacactgtacctactggcagatcagctgaccttggtgccttctggagcctttcaacttccttatccagaaaaagaggaactaacagttccacccccaaactgggtgggagtaccacattcgaaattgaagcaaagctggtcgtgtcacaggctcggcagatgttagctgtgcaggcaacttagtgaccatttgaagtaggctgtgcggcggcatcctcatcttgcagatgtagtccagagaggttagggcactaaccctgggtcacacagcgacagctcaggctacagagagcagtgctggatgggagggtgttggcagcttcaggcacaggctgggagggctgtggggtcagcagagggagggcacacttcccagctggtggggttcccttgtgcctcagtactcatgtgggcccaaaggagctggaaggagggaggttagagccacccatgggttcagaagctgataagcaggttattgactctgaatttgcctcatcgtatgtaaattggggacaaatttggggatttaatgatataatgtaagaagcagacatgtcacagccctggttatacagtcagtgtataataagtggtaagccgtcagaggaggcagccggtgagaatgggagcatctcagcagccctccgccccctgctcctggttgcagatgtacctgttcttggctatttgtgccccagctccgtgtcctccggtgtgtgtgaggccaagctcctggggtggggacttgggggtgtgtctgcagctcctgaggccaagaccaaggctgaggccgaggctgaggctgaggccaccttggtgaggaggaaattgcaggtggagaagctcgttgaccgtgaccttgatctgaccgtaattttgatggtgccgatgccgtcagcacgcaggcctcctgccctcgccacgactggctcctgcagcccacctggctgagaggtgtgctggctctcgcaggttgcaaaatggggacatcaccgtccgcctgggctacagcgtgctcgccgattgcatttggggagggactgagggctgattgtgttgtggggatgttggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcactttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaagggcccgcagagcagccatcacgcattcccgatcttggtttctggacccagctctggaaaagaagccagatcctagccacttggagctgcctagggaagaccccagcctggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgtatcaaaaaaaaaaaaaagaagaagaacaagaagtgctaagaagcatctgtcttcctgattgaaaagcaatctttgctgggcgtggtggctcacgcctgtaatcccagctttgggaggctgcggtgggagagtcgcttgaggccaggcgttcgagaccagtctgggcaacagaggtgctaggggtagtggcgcttgcctgtagtcccagctcctcaggaggctcaggtaggaggattgcttgagttaggagtttgaggctgcagtgagctatgaccacaccactgtactccagctcctgggtgacaggatgagaccctgtctcaaaaaacaaaacacaaacaaaaaaccaacgtttatcttttgtgattttaaaaatcacacctacttgtgacaaaataattaaattagaaaatgtaaaggaaatgatcaataataattgcgtcctccagacaaacactgttaacatgttcacgtttccttctagtctttttctacatagacactcaatacttattaatttgttttgaactaaagatggttttctctgctttgtatgagaaccacctcagccaggcacggtggttcacgtctataatcccagaaagctgaggcaggcagattgcttgagcccacgagtttgagaccagcctgggcaacatggcgaaactccatctctacaaaaaaacacaaaaattagcctggtgtggtggcacatgcctgtgctcccagctcctcaggaggctgaggcaggagaatagcttgagcccgggaggtagaggttgcagtgagccaagatcgtgccactgcattccagcctaggcaacgggagtgaaatgctgtctcaaaaaaaaaaaaaaaaaaaaaaaagttgccacgttgtcacctctctcagggattttcatcctttctacttttcgcccaagacttgccctgtaaaaggatgaggccaaatagccatgggagggtggtactggatgttcaaaaaaatgtttcgtggctggcgggacttagaaacaggttggggaggtttcagcagagggtggaccccagctgggggtggggggcagcaggggggcccctcacatgctctctctgcgtgtttcatggggctgcctgtgaggccgtgtgaaccagagcccggctgggaagccacatgctacctggactctgacctttcctggcagcatgaccttagccaatacgctcaactatgttcccctctgtaaaatgggctaatagaaatgtccactcgagacatgatgagaaacaaaggtgttcatagagcaaagtgcttagaacggtcctggcatgacaggagcccacatgtcagtgctgccgttggcatcgtcatcatcacggcggcattggctgctttgtttctcccttgtccctgtcaccttcttccctcagcaggctctcattcacttgttcatttattcatggccgaggccccgtctgtgtcaggcctggtgctgagaacgggggtagagagatgggggctgtgccctgctccctgacccaagggttccctttgcaatgtgaagttcttggagactggaccctcaggctgttccaccagcccctcctcaggccagcttaacccttccgtgctcgttttctgagctgttagaggaagagagcgggaggaaggatggagtggggtttttgtggggactgagcggggggtgtgtgaggccctggaaatggtgcctgcggcactcacgcagcattagcttttgctgcagttgctgtttggagaatattcttggatttcaggacactgatgacagaaggtggaacgctttttctggaagccatcaagaggggaccaccgcggcggctgagcagagttgctgacttgtgagctgtggcctgaccacagtcactgttctcatgagcgaggccccctgtggtccccctcccaggaatttctggccccttggcaggggacagttcagggctgggggtgggtagtggtgtctgcaggccctcttggagtcagagaatcccctgtcgccgtggcggggctgttccctcctgcccctcccctcccgctgtgctctcagctgctccgacaggatgcttttggcctgagagacagaaaccccaactctgaatggcttcagccctcaagagaatttggagcttttttgtgcaaaatgagatgttctgagcatcgaggatgctgtgggggatcctccatcccaccatctccagccgtggtgtccctctcggtcacaggatgctgcagccacgttgcagggaaggagagcctcccttcctgtgagcctagggagcccctccatgcagccccttcactggccattgcctgagacccgacctggtggctcctgccccaaggagcagaaagggggttcgctaggtcagggtggggctgggtgcgaggaccccccccggccaacagggtctgcttaggtgtccgtcctgttggggcagcagggaagggacccacatgtggcactgggacacggagaggcttttgtgcctgtgacggccaaaagggatggcgccccagccacgttcccacccaccccgaggcccagcatggccatgccggaaatagcagcatcgtccccctcactgtcctggcttgctttcaataggccagaggggtggggctggagcgggcgtctgacctgtggctggatctagctgcccgtggacaggctgtgagtgaatctgcagaggaagggagatgggaatgccgggaccttctcctgcacctcccgaacccccgttccctgtgagttagatggggagtgcacccctgccctcccctcctgggtatcccctgcgccccccgccccaggcacttgatgttgcctgttcattttccctctctgcccctcccgctggcccttcccatatggtcctaattaggaccttccgcccgttggtggatgggcagagaggggagcttgctgtggggcctcccccgatcgggggacttcccagcacagagctttctggcctctgcagggacgctgtgtgtgcctgtgtgagtctggcgtgttagaagcgctaagctgcagctgttctgtgcgtttttcacatttctcacttctcaaaggccctgggtttggtgtctgtgggctggggatctgtgttggggtctccaggaggcccttggtgggagaggcagggccccttcccctttaatctgggcaaccttgctttggcctgctgtctgcggaaagtgccctaggatacggtggcaggactggctggggttctggctccaggcccagccccagcccctgtcagacttaccctccttgtgcctccgttcaccctgtccacccgcagggcctgcaggagcatcctgagagttggtagggtggcctgcccggcgtccgcacagggtctgctggtgggtggctgaggctgcggtgaggtctccatggctccctcgtcctgcacatccttcccttgttgtgttgtctcgctagcatatgagcccgtactgcctctgagtctgcagcctgttttccttaccaggtggctaagcagggtggcagccagggtggcagagtcccattggcctgcaggggaccctctgtgggctgcaggtagtcccctgtggttgaaggtgccctggcaggacctgcaccatgacccccgtcaaagctcacgtccaaggcatttgtgggcacccccgccccagacgtgagggttggcatcttctcttgcacgtgaagcaaaggcctgtttgaaggagcgtgtggaagcctgggtgtgatgaaggcaaggaccggtggctcacccctcttgcacctggaccttgggtggcaggcctggggccttcagtccttaattcaggagggtagccagtcgctggaactaagagtgaacttcagctgttgttgccatagctggagggaagaggggaaaggaggcgctgcaggggagcagagacctcacccttcctctgccgacatcaggctgccggtgctggacggggccctggcaaccgtggcaggagtggtgatgtccgatgatggtaacaagggcttcctgaggaccccgagctgtcttaagggctctttacctggagtaagtatcccctttaatcctcccaacaacactgtgaaattgattctgttgttattcccatttcaccgatgaggaacccacagcccagagatgttaagtaacctgcccaagcctccctctgagcatggcagagggagggtccgaatgcggaaagtctggcttcagtgcccccatccctaaccactgtcatttacctcttcggccagccctctgattgcaaaacctgaggcccagaggagtgcagtgacttggccagcttcgcacggcaggttagtggcagagctgagcagtgtctcccatgccctgattctgtggcttcttgaggtggctcacccctaaacacgccccccatggtggctctgtttcctcctctcctctgaacctgccagcctgtgctcaggcagggggagaagtagagcaaccatgccgggcgggtcgtcgtgccccagtgccgcctgccctacacctgattggcagcagagtggcccctccttggtgtggtctggaggtgccagtggtcactcatcagcacagcccagtctcacacatgtcactcccaaaggatgttgacacagaatgaagcagctaggggaggcggacgctttggcacgagggtggcgtttctggtaatccgtagtgctgttgtctgtggctgcctttggctggcatctcacctcctcctggctgtcctgcagccacctgagggaggtcagcatgtcgccttcatcccaggacagtgtgaatgcagcagcgcaagcttgccagcgccgcactgcgggatctggaggcctttgctcctgagccctgcctctgtgtaatccctaaagcacggacttcttaggggcttccattcctccacctggaaaaaccttacaccgtttagggcttgaggcagggctagagcatggagacgttgctggaggaccaagggagaactgagcgcgtgttctcttggcctcagcctcgtgtgtgtgtttatgcatgggtactttgccatccacactggcttccacggctgggtgggagttgagttgagctcggcggctgcctttccaccctgcgggcctggttggggagtgtgaggatgcctgctggaagccaacgtgcacgaaagagttaatggtggatcccatttcctcagccccctctccagctttcccagggaaagggcaggaacagagaggccttatcttcagaggaaggggtgggcggggacacagcgctgttcggcacagtcccctctgagccaccctgcatgtttcattccaccgacttctgcagcccagctgttcagagcggatccagaaggtggagagagggtttccaataagcagaggatggagtgaatgtgagattcattactgggatttggcaaagcaaagagcctcactttctccccgcagatgggacgggggcggggctggagccagcggggtgggggtatccagcaagagctccttcccatcctcccacttcctttgccatgggccccctcctccacgcagaccctcagcctggaatgatcagtgtccagcttttctcgcccctctcctgccccgctggagggagtgacctggcccctggccccggccacctacacctcctgttttgctgcactagcctcgtggtaggggctgcggcggaggtgggcaaaagccgcttccgggcagccagcccccatcctgggagtgactgaaagtccttgggggttcctgcagggtgagctgcccattctggccctggtaaggacacccaggagagggccagggtgcctgtatttggggcacagcataaagaacagccgtaagtgtttctcaggcaggagggtgccgaagcattgggaagctgggatttagaagcattgtttggggtggtgagtggaagatgcaggacacagattcacgcgattgtgcagatcacctggcctcactccctcggtttacagtggaggaaactagaggccgagagaggtgaagtgagttccctggggtcacacagcctagccaggcccagggcgccgacctcctgctctgccttcccgtgcccattcggttggcatcagcatccctgccttgacacccccgtgtggcagctgctgtgattctgtgactcctcctcaccccaccccagtggggccctgcgagggaaagaagaatgccctatgcagaagtggttggaaagcaagaagcctggagagaagtgaggcctctgtggtttggcctgagtccaggactcatggcctggttcccagggatggagcaccgacccctcccttctacacccccaccccacgcccccaggagctccctatggggaagccggaatggacctgggctcagagattgtaaattcatcttgctggatgtgtggctgcctttatgtaaccaactctctcacggagaagccaggggatggctctcagtactctcgggggtctctcagtgaggtgggaggacctcgagaggtcaggaggctgctcaagaccttctgcccctcagggaccaggtgagggcttgtcgactgctctgacctcctgatgcttctggtggggagacctcagaggggcctgccgtcaccatcgccagtggccctggcctgcccagtcatccttctggggtggccaaactccatgctgcaaaagcccaagtgaaccccagtagtggcctgggagaatcatctgtcacgagccaaggatggagtttctggggaggactttctgctgccccccaacccctttcgggtacattctcctgtagccccactccctgtaagaaagtcaggtgcctcccgaagcttctccctggccccaggccagaggtgacagtgggggccccttgcttgcgctggtgactgtggctggttgttggtgcctggccctgccctgcactgtgcacccattgaaggcggcatcatccgggcctctccggtggccatgcatgggtgagcagcccacgacacatctgcttccagcatcgtgtgggccggggctttcagaggggctgagggcttggatggccctgcaggggggtgctcctggccttgtgaccgaaaggagctgaaggtttggagaagccgttgggccgaggtcagttcttatagatttggcgaggagggaacagatgctcacggagctgctccaggcactgcacacactgcctcactctgcgctgacagccaagaggctggttccccgccgacccccattttacagataatgtgctcccccagttccttagtggtggagccaggattcgaacccacgcaggcagcctcctgggcctgtagtcctacccttcatctccctccaggacctatgtcttggggttggcaggataatgactcccagagttgagcacatcctaatccccagcacctgggactacgttaggtgacatggcagggccagctaaggtcactaatcagctggtcttaaaatagggagatgatcctggatgatccacacgggcccgctgtcatcacaagagtttttaaaagcgcaatagaccatctgaggggtgcagtgggagaggcttggaaggaggaaggaggccacaagccaagaaatgcaggtgaacagaaaatgcaggaaaacgcagtctcccctgcagcctcgggagggtgcgcagccctgtggacaccttccctgtagcctagtgaggtggagtgtgggactaatctgtgttgtttgacatcacaagtgtgtggtcatttgctacagcagtgatgggaattgaatgccattaggcagcagtgcttctatcccggaagaattaggataaattcccctgtggatctcaagctctgggagattctgggctcctctggactgctccagttctgcaatcataggaaaggtctcccatgtctgtttgggagaagaaaaccccgtagcaaatccatttccccttttgacaaatgaaggcgagggtgtgggctggacacatgtttcctttttgtggattttttttgttttaacacttagaattctgtagctgaaggagactttggggggttgtctgcctgatttgcaagtgaagaaatggaggcccagggaagttaagtgactggcccagggtcatgcagagtcatgctggaatatcaagctagatagcccagttcctgctccaaagtgctttcctccctggttggggaggagggttggagggagtggaccccgagcaacagcagcattggcaggggttggaagagtagctactgtatccaggtgctggagcctctggccacttcctgcaggaaccaggtgacccaccatggcacaggcctctccctgtctatctgcagccctgggggccccagggaccagaggacactctggcctgagggctggggcctgagagaagagatggaagtacccctagtctggcctgcccccgtggcgtcctgcaggcatatccggcagcccaggggtcctagagaacttggctggtgggcgtccccaccttgccgcagctgcaccctgtggccagcagcttgcaggacttgggctgttgcctgtggccctgaaacagtcattttctgagctgagtggggatcaggtgagcagatccccacaccttaactgctgtgatctttctgtcctggaggctggtgggcagcctggttggtgcttcatggcactttatgaccggccctgtcaccaggctcgtgagttgctcccctcctttcgggcatcctgaacggcttccctgagagccccgccctgggccttcgcctctgcaggcccccgctgcctggggcgcctccttcccctggaagctgggcctctttggggactcattaagaagggccttgccgagtgctgccaaattgccccatctggtccccatttgttccacttaccaccctattttaacttttatgtctcctccttggctctaagatctgagcaggcagggcctgtgaggcaccccaggtcccctgatgctgccagcacccaggggactgttagtacatatgcagggagggaaggaatgaaggaagagatgacttggggagtcctccagttcccatttgtaactggcacattgcgacaaaacactcatggcattttacctttttcatataccttttttttaaatttatttttatttgagatggagtctcgctccgtcacctaggctggagtgcagtagcacaatcttggctcactgcaacctccacctctcgggttcaagcgagtctcctgcctcagcctcctaagtagctgggattataggcgcccaccaccacgcccggcgaatttttgtatttttagtagagatggggtttcaccaagttggccaggctggtctcgaactcccgacttcaggtgatccgcctgccttcgcctcccaaagtgttgggattacaggcgtgagccactgcacctggctttcgtatatctataaaagagaatttgcccagaaaatctttcagatgcacctttagggttttaaggcacagatacatgaagcttgtcagtgagcagctgctgcttattcctttttctcttccaattcagagcggcctgcgtcccaagcggacagctgctcccttcctcttggctccctgctgcccacgctcccacagaagcagggagaagaggcaggaaggtgacgcgtgatcatccgctgggcgcccgcacagtgccgtctgcacaggtgccatctcctttacttgtcactctcctcgctgagccctttcccctttttgcagatgagagagcattgcctcccagaggttaagaaatgggcccagagtcactcagctgatcagcgtgcagccagatttgaaccacatcctgctgatctccatgcctgcaggcctggcctgatgagatggacagctgggtggtggagaccttgagaccctggatggctcccaaatagggcctgtagctcctggacagggagagtctggcacaaagggtttgtggagtgagctgggggagaaggtggcttagggtccctgtctctgaacaaacagatggaggggctattccagcgttttctcagcctctggtgtgctgggctcctggttctgggaggagagaatggagctggcctccattctgggctgggctggtttgggcccaattcagacaagcttcttagtttgccatgagtgacacttttgcctgccctggtgtctctgccaaaaatatgaagggtttcagaacccccaccccggcctgcttccctcccagacttggagtgggtctggggctgacaacagtctcatgccagatagcctgagcagccaccagtgccatcaggtctgacactgcggcccctgccccggagggaaaaacaaggccctctctgggggattttctgccagcttgtgaaaacaggcctggagtcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtcttaaaaaaaaaaaaaaaaaaaaaagaacttagggcccgtatactatcttaataggaaaaaaggaaggggtgaaagcacatattatgggccgggtgcgatggctcacgcctgtaatcccggcacttcgggaggccgaggcaggtggatcacctgaggtcgggaattcaagaccagcctggccaacatggtgaaaccccgtctctactaaaaatacaaaaattagccgggtatggtggtgcacacctgtaatcccagctacttgggaagctgaggcaggagaattgcttgaacccacgaggcggaggttgcagtgagctgagatcataccattgcattccagtctgggcaacagagtgagactgtgtcttaaaaaaacaaataaaaaaaaaaaagcacatattatggcaaaacaaatgagtttttggaaagataaataggcccttaggagctgagatgggagatgtgaagtcttgtgacaatgtcttcttaggtgtggtgtggaaactactcacatcttccagggaagagtcagttgctcccagggagcagatttgggcctgtataccatcttaataggggaaatggaaggggcaaaagcacatattatgggctgggtgcaatgtgcccagtgcaggaggcagacgtggtttatggttgctgttgaaaccagtgcagggcccgattgctttgtattgagtgttgaggatcctggttttgtatcagccatgagtttgcagctctgggacacacttgatgttggctcaaggggaaatgaggttggaggggcagggtggttggattggatgtgggcctggggccattgctgatctacaaagtggtcatcacacgggaataatagagctggctacagaccacaaccagcaatattatttaaaagtaaggtcacacttttaataataagtcacattttaagttattatcaatttataaaacacactgttggtataatgatagcttttcaagaaggatataaaaaggcatgttgggctgggtgcagtgactcacgcctataatcccagcactttgagaggctgaggtcggcggatcacttcaagccaggagtttgagaccagcctggccaacatggtgaaaccctgtctctgctaaaaatacaaaaaaaaattagcttggcgtggcggcgcatgcttgtaatcccagctacgggggaggctgtggcagaagaatcacttaaaacctgggaggtggaggttgcagtgagctgagatcgcgccactacactccagcctgggcaacagagccagactccgtctcaaaaaaaaagaaaaaaaagaaaaaaagtaaaaaggcatgttgaaggtacctgcttgtggaaagttgcaacttgacgggaggtagggcgagcacttcttagaaaggtggaaatgggccctcctgctacagagacccacaaacatagactgaggcctgcagcctaggagactcaaaagaggcaaaggtgaataagagtcaaggtctccaagtcagggtctgactctgggggtgggggtcacatatgatggaggatgtcaggagggcttcctggaggtggtgacatttaccaggggggattttaggtggggtttgcgagacagtaggacctggctgaagagcgtaggctccttagacaggagtgggaattcaggcttgaaaatgagttggccagattgcaggggtcctcgaatgcaagggaagaatttcaactttaacagaggagcctgggaagctgtttgggaaaaggagtgataaagcgggaggggtcctccagcagagccctgcatgggcaggagggagcgagatgggaggtgggtgttggtaagggatgatcccagtggtccaggggagcagtcatagggtggaaactaaccttgtggggtctgggcaggaagggactgatttgagacaccgggaagaaacagccagtaggactttggtgagagggctgggggtcggggaggggggtgtggagagtgggagcttgagtctctgaaaacagacagtgttccaagggggagacctgaggcaagatgtggagaggcagctgagctgggaagctggaacggaggtgtggtcactccaggagactaagtcagggggcgaggggacccttgggagctatctagaccccagcactagggaatacggaggggagaaggaggggagaagaaccagctggtgcgtgtcaggcactgccctcgaggtcagatggggtggggctggatactggccatgaggattttttcaagagctgggttaatagtgagacgggcggacaccagatggctcgggctaagaagtaagtgggcggtgggaagctagaagccgtggtgtagacctactttgagaggttgggctgttcagacagggagaaagttcacagtttgaggaggtagataggtcaaaggaagagggtttgcttgtttttgagattggggcatcctgaacgttctcccaggccaagtgagaagaaaccagaagaggaacatgtcacccaaatgtgctgaaacagcccagcagctgcgctgcctcacagaaaatgtgcagaggcccctctgtcccaccatgcctgcctggggacggccttcactcgggctactcagggtttccccagcctgccaacccaagggtggcaggagctgtgggtgctcccagccccttctcaaggttggtctgtgggtagaaatgtgggctgcctcggggcgtcacagctacaaatgcataccagccctcagaaccacattcctgctccccagccctttcctccgcacccccatgcagaagcgcggccgccagctcacaaaggatagggagggatattgctcttggcatttgatgggaagcatctgctgcatcccattggggtgttgcccaggatggattggaaaagagttggcaggaaggctgagctctgtgctcacaacctggcttggtggtggccgaggagcttggcaggagcagagtgcaggacctgggaactgggggttggtgcatgtgtgcacgcacgtgtgtgtgtgtgtgcgtgcgtgctgggtgggtagggaggaagctgtgaaaccacatcccctcctctctgctgctgtgttgctgtgtgtttcagcagcacgtgggtgtcaccacacttcctagcaggtgtcaacctccaagactgttctgggctcttctcccagttggctgagttggaggtgggagtcccaactgtcccctgtggcttccagagtgggaccttgctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaagcaacagaggctccttcctttacagtgctaagggtcagaagccgatcagtctcaccggactaaagtcaaggtgttggcagaatccattcctgcctcttccagctttgggtgggaggctctgctggagttccttggcttgcggctgcatccctccagcctctgcctccatcctcctacagcctcctccttctctgcagtcagatctccctctgccttcctcttttttttttttgagacggagtcacccaggctggagtgcagtggcacaatcttggctcactgcagcctccgcctcctgggttcaagcgattctcctgcctcagcttcccgagtagctgggattacaggcatgtgctactacacctggctaatttttgtatttttagtagagacagggttttgccatgttggccaggctggtcttgaactcctgacctcaggtgatctgcctgcctcagcctcccaaagtgctgggattgcagccatgagccatcacacctggcctgcctccctcttaaaggacgcttgtgatttggggcccacctgggtaatctcttcatctcaacatcttcagttacatctacagagtccctgttgccacatgaggtaacacagtttgggaagggagagttattcagcctaccctaggggcctgtggtgtatctcagggcccttctgattttaagatataaagcaagaaaacaaactggctcaaggggaaaaaaggacacgttgaattctgttgctttaaatgtatatttttttattgtgctaaaatgcacagaacataaaatttgccattagtaacactgagtacattcacagtgtcgtgcaaccatcagcactgtctagcgccagaactttttcatcaccccaaagggaaaccccgtatccatgaaggactcactccccattcgccctctccagcccttggcagccaccagaatgctttctgtctccataaattcatttttaataagtgcaattctgtgtgactttaaaataaataaacatgagcacgatgagttgcttattggaaggatatccatgcggggaggccggcgtgtggagtgcgtaggcctccggacgggcaggagttgaaggggcgtggatgtgccgccctctcctccccttgctctttccttggggtcactgcctgagtatccctctttgcaaatggccccaaataatgtctcagcccccacgtctgcatcgcctcctagcttcaggaccctccaccaaaaaacattccaagcttcagactcactcctgggaaaattccaatggcctcactctcccttttgagccagccagatcccatggcctgtggcgggctgcctttgagtcctgagcacctgtgagctagggaagcaggacaggcacacccagggaaggggaagagtcgtcgtcagtcacagtaattgatatctttggaatcgtctaagagatacttagcgtgtgcctaaaacattcatttctttttttgtttgttttttgagacgaagtctcgctctgtcgcccaggctggagtgcagtggcgtgatctcagctcaccgcaacctcctcctcccgggttcaagcgattctcctgcctcaacctcctgagtggctgggactacaggcacacactaccacgcctggcgaatttttgtatttttagtagtgactgggtttcaccatgttggtcaggctggtcttgaactcctgacctcaggcaatgtgctcgccttggcctcccaaagtgctgggatgacaggtgtgagccaacacacctggccacattcatttcttaggagaagctctgcattttctgaaagtgaaatgtccccaggcgggtgacactgatggtgggatctgtggcctcaccagtgtcttatgagagatgccgctgtgtgtttcaccaagctgtatcctattgtcctctaaatgtggcttgtagacatggtgccgagaatgatctgggaggttcaaatcataatatggtccaaatcaacagctctctgatgacctggtattatcctaggatcaaattgagactatccgaggatgggcgtggtggctcacgcgtgtaatctcagcacttcaggaggctgaggcgggcggatcaattgaggtctgtagtttgagaccagcctggccaacatggtgaaaccccatctctactaaaaatacaaaaagtagccgccggacatggtggtgtacgcctgtagtcccagctacttgggaggctgaggcgggagaattgcttgaactcaggagacggaggttgcagtgagccaagatcacgccattgcgctccagcctgggtgacagagcaagactctgttccccggcaaccaaaaaaaaaaaaaaaaattgagactctccgagctgcactgtccagcatgatagccactggctgcacggggccatttgaacacctgaaatgtggtgattccaagtggagaggtgccgtgtgtgtgaagtgcactctgggtttcagagtcctagcaagggggaaagaaaagaatatcaaatatctgtcatttttacattgattacatgttgaattgataatattttgggctctgttaagtgaatgatattaaaattaatatcacctgttcttacattttttaatgatttcctttttcttttcttttctttttttttttaaatatggggtctcacactgttgcccaggctggagtgcagtggcacgatctcggctcactgcaacctttgcctcccaggtttgagcgattctcctgcctcagcctcccaagtagctgggattacaggtggctgctaccatgcctggctaatttttgtatttttagtagagacagggttttgccatgttggccaggctggttttgaactcctgacctcaggtgatctgcccacctcagcctcccaaagtgctggtatgacaggcgtgagccactgtgcctggcttgttcttacattttttattgtaggtgctggaaaatgtaaggttgcgtctgtggcccatgtgccgtttctgctggagggttggaccgagggccagccgagaaggctctggggctgctctacctgaatgctgagtgtgtgctgagcggtagagaactttgagaagtgctgaaggacagaggctttgtgtgggggatgcagccccaggccggagatgccttctctgtgctctggagaccctcatttggtgacagcaagaggaaccactgcaagaggggcggccacctcagcaaagcacccaggatgctggcctcccagctcaggaatccagaggcagaggaggggaggaggctgggcttggaggagagcagggtcttgggccctgggaaaagcctggggggccagaaagctgggggacagattgaggccagaggcaaagagaagaaggttcggagaggagggccaaggaagaagggttctgcccacggggagggagaggcccacggggcaggggcgtggtgggagctgcatcctcgaggctttctgttgaccctgacacctggccagaaaggagttccttctggcatcctttgtcagcggtttctggagctgccctttaggggccagtgatgagggtgccctgggctgggctgcagacagtggaaaagacaggctcttctcactcccagtgctggggaaattagcttcttggaggaagggggagctgtattttctgagtggccgcacttcctggcctagacgtgtgtgtcttgctgtaattttggcgactggtgttggtggtgcccattttatggatggggaaggtcaaattccacagatattgagtgacaggcccagggccttggatttcagtgtttgactcagaacccaggtctctgatctgccaccagcctccctcccattcagatgggaacagggactccgggcatgcagtcttctcccagacactcccccggctctggcctggcgcccggagaccagtagcagcagctccccacggccgttcactgtgagggtggggagggccgtgggaccaggaggccttagggggaaagttggccatgaggagtgggaagcgacgggtcagatgccagtgactgctggctggggagccgctggacgtggctggcctgtttggccagtgtggcgggtgccccggggcttcagtcacccccagccacgtgtgggggtgcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggccccggcccgaggccggcaggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatgccgtaaccgaagctccccgcggcgccggcactgggatccagggagctgctgctacagcgcagctctggattcctggatgtgttggatatgtgcagggcgttcctgggaggagcggggagggagggtgctgctggcggggctggtctgcgtgtgctttgcttctctacaatggcatgctgcgtgtcggccatgcagaggcatgtcagtgagcaggggctgagggatctccctaacggacctgctttcagagggtcttttcatgctgggagaaccccagagactaaatcatgcagccaacggggtggtccccggcctcaaagcagggaggggcgaggagctttgtaggcaatgccatctgctcctgaaacgccgtcccagtgactctggggactgactcagcctccagcctgctgcacttcatccctggcccctctctctttgctttttcatgtgaaatctgctgtgttttggtcagaggtttggggaacagctctctgctcatctaagataagtttgtaattcctttcctggagaaaaatatgccacccggaagcaggttgagcagtggttttctggcaggtctgttcggggctgtggagacagcacctgctggatcaggatggagttggaatttggtttggatcccacatgagaaaacccgttggaagaggaggaagcagaaaaaggccccattccctaataatgctgtgggttttcctcctccattcattgccaccttgccttgaaacttaatggggccacgtgtgtttccatgaatgtcattctctttggccaactcccccggcagccccaggagctccttttcaggaaaaggaagaaggtgtttgcttagcatctagtatacgagtccttgttggaaaggtgggattcttgtttctccttgggtctcttttaggctgagatgtggtcaaggaaggcctgtggtgtggctcgccttttttaatgctcgtctctggagacctgagttgctgctgactcccagcttgccccttctgtcccctggccatttctgtgtcggggtggctgagacactattgcattggccactttgtgttcccactagcccccgcccctgtaggctgtcattgtgatggtgatggggccaattcagctgcggtggggaggacccactgtgtgcgcctggggggtggcgtggggcactctgggatgagaagatgcgacttctgccctgagagccctgctttaatggaaggcgggggcatagttgcaggcagaagccatcaagcactgtggtcagaccagcattccatgtcaaaaatggccttgttggccgggcgcagtggctcatgcctgtaatcccaacacttcaggaggccaaggcaggcagatcacctgaggtcaagagttcgagaccagcctggccaacatggtgaaaccctgtctctactaaaaatactggctaatccgggcatggtggcgcgtgcctgtaatggcagctactcgggaggctgagacaggagaatcacttgaacctgggaggtggaggttgcagtgagctgagattgtgctactgcactccagtctgggcaacaagagtgaaactctgtctcaaaaaaaaaaaaaaaaagccttatctgggcctgggatctgtcctccgaacactgggtccactgtgctccacaaggactttcaccccggaagccctagacccacttgggcaaccagagtctctgggttgaccactccccagccctggccagcctcctgggccaccgtattctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacaggtagggacctgttcccggagctcagcagagccttgggaagctttcccaggagggctcccgagggtggcggccatgcccagtccgctgtacgtgtgagtttgtttgatgaggaattggctgggaaggcgcgggtctaattacaggcccatgagggtccctctcgcccccacccaggaagcagcggagatcctggcacactcagcacctgggcctgtgcctgcccagctgctggtggaatcatgggagccttgctccggggcctgtagagcagcagtgggaaccttccccacctcagcccctcccagagttggctgttcaaactcgccgccgctcagcctcttcctcctctctttcatcaaccctgggaatcgcacactgcccaccccaccgggccccggagcgggtgcaggaagagagagcttaacacccagaggtctgggccttctgcaggcgcctgagctgctgtggcctgagctgggttccctgctggaaccatcacagtagacctaatgatctgcctgcaggagttgcttcatcccagccgactccggggctgcgggaaggggctgggccttggttttgctgggggtggggggtcagtgcaaagggcctgaaaagtggcagaggtgatggcccatctgtcctccccctggccggccggcctaaacgcgattggctctctttcttttttttttttccctcccttttccctataaataacactaaatgcgatttgtcaatgcattcatttgggttcagtagttggaccatgggcagaagcactccagatttgtcactttccctaagctaagggtggggaacaccctctgtgagatcttggctcctgagcgcccaagactgctcttggaaccccaactctgggtcggtctcaggggactgacgttgatggagttgctgacattgacctccggcctctgcatggccttcaggaagggggcccttcgctctctgtcccgtcgagcctggctggcagcactcccttctcaggcctgtgcccccggcagggcctgctgcccccgccctgctctgtgggtgccaggctccaagcaccaggtgactcggtcactgaatggtcactgaacagtcatccttgctggtgtccccagtggaatgtgcatggacgtcctccctcccccagatccttgtcttttatctctcagcctttgttccaggggccaccacaggaccaggaggtacgcagacgtgggtggcacatccactgggcagattcagccctgaacctgcacgccccctccaagggggcccccagcgggcggggttgatggtgccgtctctctctctgtcactagaacggacatgaggattgtgtcttgtcgatccacgtcctgagttcccagacgtcataggtgcttgctcaacgagtgtttgaatgaatggtcagcattgtgtgaccgcagattttcaacttttatccaaatagtttgtggtttctgtgaggctatcccgagacagtctcacaagaatctccattctccctgcacgctccgcacaaggtctccttggggggtttttcagaaaaagggccaaagagcagcatttcctcggggatttgaacacgatctcccccggggcaggggactgccctggaagattcccggcaccgcttcccatgcgccacgtgactaggagggtcttggggcaggatggtgtcttttgtgccttgtgtgctggggccggaggaaacactgcccgtggccggtgtcatctgccagccctgaagactaatgatgggctggacagtggccccattgagtgggagggagaatcgctgctgtctgtagctggggggccgggtgggtgggagccgaggccagggagaacagcgcagacctggcacggagaggcctggaggaggagcagggggtctcagccacccagggtgcagggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccaggtatgggccccacaggcactactggctccccgaagccagggacagaccccatagacaatactgagtccctgcagccagggatgggcccccacggccagtaccagatctcagggaccagcaccgggtacccacagccagggacaggcctccatggccagtaccaggtctcagggaccagcaccgggtacccacagccagggacgggcccccatggccagtaccagatctcagggaccagcaccgggtacccacagccagggacgggtccccatggccagtaccaggtctcagggaccagcgctgggtccccacagccaaggacaagtccccacggccaataccagatcccagtgaccagcactagatgtccacagccagagatgggcccctatggccagtaccaggtctcagggaccagcgctgggaccctggatgactgaaggagggcacggttgactaaagctgcaggagccagcctggccatcctgaggcactaagccatcactgcggtctcaggggactcagactcctctacttgtcttcttgaattctggaatcagacacacctgggtccagcctttgcccccggggctgtgtgcctgggatggttgcctcacctccctgaagctcagtgagatggggacggctgcacagggcccggcacagatggcacccgatggcacagggtcacctgcttgcatccatacagcctcggccctcgctctggctgcgtaccgagagtcccatgcccagacctctgctgagtctccaagctcctggtcatgcctcaggcctcccgtgagaagcatcactgcatggaccatgcctcgggacctcaccttgggctgggaagcttgctccatctccccaagtctcccctagaggcgccccatgtcccatcactctcactgcttgaggggtcagataggggaacccagtgtgggaggcccagaggtgccggagcagacgttaagcgagttccgtgtttatgcgctgggccttggcagacaccctgaatgagcctcttccccaggaaggagattggggtcccagtccaagttgtggcctcaaaccctgtgaccaagagtggagaaaaggcaagacccctcctcccagtcttccagaacagccgatagtggtggaaacatggggttcacactgaatttccttgtaacttgttgaagagaatttagcccacattttcaggggtggaggtctggccgatttggcagtgtgcccgtccccctggccacagtttactctggaccgggcaccctggtgccctccctcagtgacgcagtgaagtcactatgacgtgtttagttggtgagaaagtgcctcctgtaatgttttactcttcttagagggtgaataagccttgtttattataaataattatttacagaatacatgaggtttaacctaactctgggccacggcagcgtcccctgggtaaacccacgcgccaccctagctagagcctgtgcccccacaggcttcctggactcaccctgaaggggggctggattttctgcctgtcccgatgagagggctgcaggacagtccccagcgagcccttctgagggctgtaacctcttcccctggtattttcctgctcgccaggaatgtttcaagcttccagcagaagcctacccaccatagtcgctttccaccctgctcaccatccctcctgccctcactcattcagcagaccccgtgcacagcccagtgcaggactcagggtgggaaggtgtcccgggtgggctggagcaaggttcccagccagggcggggtcccaaggtgggtccacagccaggactgtgatttgggaggcccctccctgccttgttccagccccggcaccgccgctgtccttgtgctcagtggagactcactggctccaggctctaaaacctcagcgaggtctgcagacagggaggagccccactcgagggtagagtgactgccgggtccatttgcctgttacgaaccacgtggcctcagacctgccattcctcctctcctagagctatggtcttttgtctgaaaaatggataatgatggttaccatgtcagggaccattttgaggacaaacggggatgaaactgaagaggctcagcacggaacctggacacagaagtgctaattgtgtgttaccagctgcggtggctgccaaggcccaaccacatggcagccacgggctgagtggcgggcgggaagtggggagcaggagcatgcaagatgggcattcctgaagtttctgatccagtgagataagtacacacccagctctaagatggagtgtcccaggaaggtggagactgcaaaggccttgtggcgcaggagtgtgagctgcacctctgggctctctagaatttcaccagagctcagggaggaggtcagctcagatataggggcaacgggagagatgggagtgagaaaatggcttggcgtctggaagtggagcctggaaaggtgggcgtggggacagaggagggccttgggggccatgggcccatgcgtccaggaggtggaggcagtgaacggggccacggtcggccccacacgtggcaccaccagccctgctgagcctgcacctgctcctcaggccccctgagtgccactaccacctggcaccccttggtctgattcctgcttcctgcccgcctgggaagagtgagaccacttgcctaaagtcccttagctgtccttaaccattctggctgcctcctggccctgtccagggttagccgttgacctgaactgcctggtgccacctccccagactcctggggccttgccctggcaccaacagccacctccatcttcatcattcactcgcacattcacccagcagtgctttttgggcatccactcagcaatatcaaggcgctgagatgcggctgtggttaagacccgggcccggtctgtgaggacctcgcagttgccatttccccagagcacagccccagccaggcacactgtggggtccagaaagagaaactaatacattgtgttcgtccattttgagttgctataaggaatagccgaggctggggggttatttgactcacggttctgcaggctgtacaagtggtgccagcatctgcttggcttctggggaggccccaggaagcttttcctcatggtagaaggtgaagggggagctggcacgtcacatggcgagagagagaactcccagactctttttttttttgaaatggagtctcgctgtgtcagccaggctggagtgcagtggcacaatcctcggctcactgcaacctcagcctcctgagtagctgggattacaggcgcatgccaccgcgcccggctaatttttttgtatttttactagagatggggtttcaccatgttggtcgggctggtcccaaactcctaaccttgtgatccacccaccttggcctcccaaagtgctgggattacaggtgtgagccacctcacccagccctcccagactctatagcaatcagatctcccggactttgtgaccgtggggagggcaccaaaccatccatgagggatccacccccatgacccaagccccaccccccccaggccttacctccaacatcagggatcacatttcagcatgagatttggaggggacaacgtccaaaccatatcacacgtgacctctctgtgcgtgcgtcagtttctacatctggttaagcagtagaagctccttctctgttccttgttgagagagcggtgggggagaaatgactcagggatgggaggctggtcccccgaggggccctggtgtttgtggagtgggagtgcgggaaggcccctacgttgtgtgtgccgtgctgggctggctcctcacagctcaccgtggtgctccccgaggactgctggggaggaaagagctaattaacttggggacccagctgctgaagttatcattaaacttgagcagtccaggggcccctctccttctgggtcctatgtcacccagcacagtggggcttaattgaattttttctcatcccccaaggctcctggctggcgtggctggggtttgggatacggggagcgagagggcttgggcctcttccagatttggagtgggttcaccagaaatggcccaggaaaccgcgggggccacccccagcagctgggggctcctgtggtcatttcctcttggtcctgttgagcagccctggcccctggagccctcagcaagggatgtgggggcctgccaggccagggtcctcactgctgccgctatgcacagctgcatcttgcatccggggagtggggtgccgagtggggtgtttgggaggcaggttttcccttgtcccttctgcccagagaccttggggatgagttgagtgagacccttccggcttctgactggctgtgtttctgttgccatcccccactccttttaagtggaggtttatgacttccttctttatttaaaagggtcatttagtgacttagcagatcccagtctgtgttacccagggcccttttaaaaatctgtggggaggctgggcttggtggctcacacctctaatcccagcactttgggaggctgaggcgggtggatcacctgaagtcaggagttcgagaccagcctggccaacatggagaaaccctacctctagtaaaaatacaaaaaattggctgggtgtggtggcacgtgcctgtaatcccagttactcgggaggctgaggcaggagaatcactcaaatccaggaggcggaggttgcagtgagccgagatcacaccactgcactccagcctggacgacagagtgagactctgtctcaaaaaaataaaaataaataaataaaaataaaaatccatggggggacctctgtgtccattggctggtgtgaggagagggtgaggagctgcagagaaggtaccaggctgaggaccgcccccacccttgggctacagaattgaaggaggggacacatgaaagatgttcctagactcgggctggaggctggggacatccgagggcaaggacgacgctgtccctgctcttgtttgcagaggagtgcacagggctcaccagcttcttgttgctgtttaagtgatagctttatggagatagaattcacatactgtgacgttgacctttttaaaatctacagttcaatggttttgctgtattcacaaagtgattgtattagggtcatccagagaaacagaaccaatagaaggtgtgtacgtgtgtttagataaagagatttattattatgaggagttggctcacctcattacagaggttggcaagtgccaagattggcagagtaaatcagcaggctggagacacgggagagcccatgttgcggctctggtgtccacctgaaggcccaagacccaggagagccaatggcgtcgttccagtcccgagacccaggaaaagcgcatgtgtcagtttgagtctgaagcaggaaaaatctgatgttccaggttgaaggcggttaagcgggaagaattctctctcactcaggccttgtgtcctcctattcagaccttcaggcctttgtcacaaaattacaaagacctgatcagaacaaaatctgagaaaaaaccctttccttctatcggttttggattcattggctgggaccctggaaattagactgacagagattaacaggaaacaagcataacaattcaagtaagttttacttgacaccgagccttcataaggaaatgaagacccagagaaaccgttagcctgagcggtttttgttttgttttgagacaaagtctcactctgtcgcacgtccaggctggagagcagtggcccgatcacggctcactgcagccttgacttcctgggctcaagctggggcccagctgccggccccgggagctgctctgaacccactcttaagtcccagctcagactcccaagtagctgggactacaggcatgtgccaccccgcctggctaattttttattttttgtagagacagggtcccactatgttgcccgggctggtctcaaactcctgggctcgagcaatcctcctgccttggcctcccaaagtgctggggttacaggtgtgagccactgtgcccggcctaggcctgaacagtttttatttgttttgcttgttttttaaatttgtttgttgcttgttttgagcagtttttttgtttatttcttttgcttgtcttttgcccaggctggagtgcagtggcatgatctctgctcactgcaacctctgtctcctgggttcaagccattctcatgcctcagcctcccaagtagctgcgactacaggcgtgtgccaccacacccggctgatttttgtatttttagtagggatggggttttaccatgttggccaggctgttcttcaactcctgacctcaagtgatctggccaccttggccttccaaagtgctgggattgtaggtgtgagctgctgtgcctagcctaggcctgagcgtttttatgctgggtttgatgaagagtggaaagtcgtgggaaactgtgacagagcaacaaaagatgagctgaacagtgagcccgtgggggtctcggcaagacctgtgtactggggcccctctcagatcctctgtctctggagatgaggctgttcctttccgctgggtgtagggagggcacctcttacgtgaggggcttatgatctacttcagagaaggggcaggtcagtgagttcttcttggacctgccatttcttaaattccttcagctgaaaatatttactatgccaaggcactgtatcttggagtgtgcgttccaagccctgttgccttcaactgatcgggtgaggcccacccccatcagagcacacagtctgctttacccaggctcctgattgcacccttttcctgtttgccccgagaatactcaccagcagtgcttgtggctgcagcgttcaccccaagataaatttgccgggaagtatcttgcttttattattattttcacatcactctagtatatcgactttggaaacaaaagacatcattctgtttatagcattccatttttagtagtggtatttcctttaaaaaaaaatggtaattctcagctgggtgtggtggctcatgcctgtaatcctagcacttgggaaagctgaggcaggctgatcacctgaggccaggagttggagaccagcctggccaacatggtgaaatcccatctctactaaaaatacaaaaattagccaggcgtggtggtaggcacctgtaatcccagctacttgggaggccgaggccggagaattgcttgaacccgggaggcagaggttgcagtgagccgagatcgcgccattgcattccagcctggacgacagagcaagattccatctcaaaaaataaataaataaataaaatttaaaaaaaaatagtaattctcgatcgctgaaaatgtcaaatcctagagaacacagcattcctacaagtgatgttaacattgttcttgatcagttgttggctgaagattcatttgatgaatctgatttttccagaatagacgactcagatgactctgttgttttgcttagaaataactgcaggaacaatttaaaaaattttttttctttttaatttttttgttttttgagacggactctctctgttgcccaggctggagtgcagtggcacgatctcggcttactgcaacctctgcctcctgggttcaagtgattctccagtcttagcctcctgagtttagctgggattacaaggtgcctgccaccacacgtggctaattttttgtatttttagtagagacggtgtttcaccaggttgaccaggctagtctcgaacccctgacctcaaataattggcccatgtcggcttcccaaagcgctgggattacaggcgtgagccaccacgcctggccagtttttatatttaattttcacacagagcatccagtcagatttgcttcagcctcaaagagcgtgtttatgtaaaattaagtgagtgctggcagtgagctgaactttctaaaaggtaaaagggttaaatattaaactcatccaaaaacaccttcacagacacactcagaataatgtttgaccggttacctaggtgccccatagcccagtccagttgacacagaaatttttttttttttttttgagacggagtctcgctctgtcgcccaggctggagtgcagtggcgcgatcttggctcactgcaagcttcgcctcccaggttcacgccattctcctgcctcagcctcccgagtagctgggactacaggtgcccaccaccacacccggctaatttttttttttgtatttttagtagagatggggtttcaccgtggtctcaatctcctgacctcgtgatccacccgcctcagcctcccaaagtgctgggattacaggcatgagccactgcgcccggctgacacaggaaattaaccatcacagttacacagccatcgccattaatcccagcacatttcatcatccccaaaagagaccctgcccccattagccaatccccattcccaactccgggctctcagcccctagccaccgctcatctgccttcgtctctatgaattcacctgttctagatagtttgtataagtggaatcgtacagtatgtggccttggtgtctggctcctttcacttggtagaatattttcaaggctcatccacattgtagcaggtgctggtgcttcattctttttcatggccgaataatattccatcgtggatagaccacactgtgtatctcttcatctgctgatggacatttgggttgtttctgctttttggcataattctgttgtgaagaattctgcagtgagtgctggtctacaggtttttgtgtgaacatgttttcatttctcttgggtaattgcaagatcatgtggtttagccaaccagcctttaagccatgtgtctgctgagggacccaggcctggtgggggtgcattgctgtgcttggccagccaggtgctgcgagtccgtgtcgcagccatttctctgtgctgtgctctgaggttgtctcgccggcaccgggcactgtgagccccaggaggccaaagccccctttgttttatcttgagtccaggcctcgctccatgaactaggatgaatggacattgaatcaacgcagggatgggtggggctggggtggggacgcagagtgaccccgggggcctgcagctgggtcctggctgctgacttccagtttcctttgcctgttggagcccagaacaagtcagaaaggggaaatgcaaagttcgagtgtcttttctgtggtagactggcaggcctgggtgggtgagccacttgcagctagttgcagcgtgagagaggaagtgggaggggagggagagggtgagtttggtgtaactcacccctggaaggaggctgggctgaggctgggggaagtgacttttatttttctgagaggattcttccctggggccaacttcaaaccaagggagacaagaccttcctgggggaggctggaagtgctggggcccccaggtgggcaggtctcccagggccaacgtcttggggaagctataagttaccatgtttctggactgtcacacacacacacacacacacacacacacacacacacacacacacacacacacgagtaaactgtaacacaaatgtgtgcccatgaaagtgcccactttaaaccaccacacagcctgtaaagcgaaggccctggcccgcatctgggcacccactgcccagccagccggtaggcagtttgcactgtagtctgttaccatccctcagagatgcagccgaggagcccagctggcttggagggcccagtgggcgcagcctcaggaaagtggtcaggcccgggccaggccccttccccctcccagccttgggagaaattaccatatgaatgtagctccttcccggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacagtaggtcaaccccaggccctgggtcctcgggaggaggagaaagaagagaagcaggaggtgtggagggtaggccaggaccagaaggcacacagggtcggggcagtgtgggagaccctgggggctccctcatttaaccagctaacatcacagcgttcataagaacacgctattactgcagttttattactttgctctgatttcagaaggcacaactgatgactttagggaacggagaatctgaggaaggcctcgcaggagagggtcagatgcgatcgagtaaatgtgagccgtctgtaaactgtagagtgcacgcacagcaccggtcagccctggggtcagtgttcccctggtgctcagctcggcctctgcaccttttagtgctcggctgggctctgtgggggtcagggctgggtctggtacattagaggacttctaccaagcccctggcagtgtctcagttactaaatccagtttgccagttactaaatccgctctgccggttcccgaatcactcttccgctggggccggccatgtcacgtcaggcttttcatgcaggacggcagatggatagacgctgggaccaagtcatccttgggccgcgagacgtctgaccttctgctggtgtctcagaagatgctagctctccgtggcatgtcttccacgcggtgcttggggaccagtggcctctaaggggcccccctgcctcagcgtggggagtggcctggccaaggtctcagtgtctggttggagccaggcataggctcaggtgtactggctggaggcctcctgcccatgggctctgcctgtcctgtgtccctggtccttactgtgtcttctgtgttcctgggagagaccccaggggccctgagcccagcactggggttggggagtgggcggggaagagggtggggattagggtccctggctgcagaacagccaggccccaagtccccactccactcccctcccaccgggcgcctcatcccacactgaccatttcctgaagaaaatttcctgaaccggcctcccaccccggctgtcccaggaagcccatccatccttccgccttaatgctttgtggctccagaaggatggtggaagccggaaatcatgagtctcattcacaggcggccacacaccgaagccgcggagacgccgtgggaaaggactctggccagcgcggccggcacagagggagcggtgttaccggggtagacgggaaccgtggctgcccccatgctggtctgggagagacgaggggccggacgaaaggacagcagactggccattcattcatttattcattcactcattcacagcgtcttactgggtgcttcggacgtgtaaggttttgtgggtagtgaatgcgacagaccccagacagcaatcggagggccacgtgtgtaagaactgagggacctaggctgggcgtggtgtctcaagcctgtaatctcagcactttgggaggcagaggcgggcggattacgaggtcaggagatcgagaccatcctggctaacacggtgaaaccccgtttctactaaaaatataaaaaattagccgggcgtggtggcgggcgcctgtaatcccagctactcaggaggctgaggcaggagaatggcgtgaacccgggaggcagagcttgcagtgagcccagatagtgccactgcactccagcctgggcgacagagtgagactccatctcaaaaaaaacaaaacaaaacaaaacaaaacaaaaactgaggaacccagtgtagatgagctatcccgggaaaacaagtgggagttctaggaacagcatggggaagggatggtcccggcagggaggacctctgtgggtagccttgttggaagagctgaaaggcagccagagaggctgtgcgtggatggaagctgaagagtaggttaggggcgtgtgttttgttaacaaagacttcaagcatttactgaccaggcacaacactatgtgcttcataaataaatatctcatttgatccccagcattcttatgagacagatgttattatcccatttcacatgtaagaacattgaggcacagagtggttaagttacttgctcagggtcacacagcacgtcggtggtaggcaggattctggagccacaggaatctggtatatcccaggtgcaatggaaaccagtcacggcttcatagagggaaatcatcagattagtaaattttacacacgccccctggtgctttgaggaggagggattcggacaggggcagctaatggtggtggctgtgagatgtgttgggttaacattgatgagagtttgggatggatgagtggattcggagtaatggaaatggagggcccaggcccggcccctggagatctagctgcaatagctgttggctggagaggctgttcacttagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctaggaggcaagggtgacccctgtgtgtttcattcttcagaggattggtggctccatctggtcagaaccccaagtccagagatgcatctgagcttcatgccatggtgcaggcagcaggagccatggagcaggcctgcggggtcacggcctgcctgctgcttcctggtgtctctaccctgagctcaggggttgcttggatgccctgtgctgcatccccccaggcggtgttccagagaggatgaaagtggctatctcaaggtgtgaccaggtagcggtccatgcacactgctttttcctggggagagtctgggatggaagggtatgtgtgtgtttctgagactccttgaataggctccatgtacctatccacccatcttaccacccacccacccatccactcactcacccatccacgcacccacccatccacccatccactcatccacctgtcaacccatctatccactcattcacccatccactcatccacctatctacagtcattcactcatccacccatccactcatttacccatctatccatccactcatccacctgcccatccactcacccacccatccactcatccacccatccacccatctatctatgcactcatccacccatccactcatccacctatccactcattcactcattcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctctcaactcttgtcagtccaggtgggtgctgcatggattgggggcacctggaacagttggccccttcacccctttcccccacctttccagcccctctggctataatcagacagttgtgtgcgatgtctttctccctcctgaaggggtcatttagtcaggctcctactcatggcccaggaatgtgcccctccctgcctgtcccctacccccaagcaggccgtgcctccagccccctgctgtctctgaagggcctgggcatggggcagcctctgcagcatccccagggcccgagctgatctgcacagcagaagggaattgggggaaagctttttttctacccagcacctggcagggggccaccctgttgcaccccagagacccttgtctaagttttgttatttcagatgatttcataagttgggggaggcggagccccagcccccacagcccctgttgttgcctcactgctgagctctgctgtgtatctgctgacaggtctgctgatagcagaaggggctggagagagggaagctctgggccctgccctccccaacccctgcttaggggacatccctgataagaggaaattccagcctgtgacagatggccagtgtccacccacccacgggggaacttttctttctctttgtaagtttgcagatttgccaggaactaaaggaatctctggttgacaggccactgtggacatggctggagggctggcacgggctggatcttggggttgctttgaggtaggggccgctcctgctggaaggttccttggggtggggaaggcatcagggccattccctgaccctccctctgcagtggatccacttcagagcctgagacaaggcaagggggcagcagaaaacagaatataaaatagccccccccaccacacaccgcaccagaagtcagaggattcatccttggcctgccctccctgcagcctaagttctgagagtggctctttaggaagtgaatggtgatggtttgcaggtcagagcttgctctggcccaagattgatgtctcaataggccgcggagcctgggtgaaaaaactcaggctagggaggtggtgggttgcaaatgaaagaacagaggagggcctcttccagaaagcggcgggtggtgtgaggagcccttggaccttgtccaaatttgactttaccgactggggccaattgaaaccgtgctggcagaaaggcaaaactgcttgagattccttcctccacaatagaggagaggtttgcttgaaagggtttggcgagggaaaagctggaggaaccttggccggcagtaaaagtggggacccccgccccctgcctcgggggcgcctcggcccctgaatgaatgaaagaggaggctggatggagacagactcacaccacctgtcccttccaggtcctgcaaaggagcacacagggttcttgttggctcttccaccttgttagtcaccaagaaggagaaaacaccaacaggggaactgtaaagctgcagttttgtttaagccccatagtggaaaccggaaagagctccagctcggagaaaaatgcagctctttgcctttgcaaatccgtgtctttctctgggaggccagagccattgtgctcgatttctaagcagggtttcagagtgtctcaggaggggaaggcagagtctcagatttccggcatcccaggtcctaaccaggctttgaggagacgcttcctgtcccatacaaagtgtgaagtgtaatttgatttggagttagttaacaaattagatgagctgtgtgcattttaaaaattcagtccttgatcccccacccacacacatttgcacaatttggtcatttatattcagtgtttccatctttagaagagaacaggaagtccccagtgacatttatggagtgtttgtagtagcttgggtaggtcagtaggaacacaatgcagtgaaaagcagagttgagatgggaaaatatcctgttttcagagccccccagggatgacattccttatcgtctctgtccacccgctctggagtccactccgcaaacagcaacttgttctcacttgagagcttcctcctgccggagctcagggatggagagcagctggcctcagtcttctcctcttacctctttgtttctcagactcatcttccaccttgaataattgtttttaacctgctctccctcttctctagctgtagaacccagaactttgtgtgtgtggtcaaaagtttagagagtgctgcaggtaatgctgagataaccctattaaattctgtaagttctcatcacaccaagtttgtttgttttttttaattctcattttattttatttcattttatagggatggggtctcgctacgttgcccaggctggtcttgaactcctgggctcaaacgatcctcccgcctcggcctcccagagtgccaagttatttttttaactgggatccacgggcctagggattctttgatgaaccgttcaaaatacgtgtgtgtctgtctgtctgtcttcaatgtatacttttctagggagagtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaatcaatgttatggtcctggtccactaggaccccaggatcatcgtctaccattattgtctatagtttctttaccatcttgttccagagcagttctttctctgaggtctgctcacctctgcacgtgtgtctagtttccagccctgtcgccttaccattctctttcctttacctgcatttcctgaactgttaatagttaacaatagcttctccctccacccactcactcatacctgaagtgagaagtcatcattgaggtctctgtggattttgtcagcccaacctggggcggcctcctggaggtggagttttcagatgagggatggacattttggtgtctgctgggtagatctacctgggagctttggcaggggccccagggcagctctgcctctttattttggctgtgggacccctggtgcactagggtttctcaagtaagcatctgtgtcctgggagagccataggcaggcctgagagggcccctggaatctgggacccccagcccggcccagtagctggtaccatcatctttcttgcaagggaagttatggaaactaagatgctaatgtgctttgataggcctggggtggctctaagccctgggaagagccctggcaactttccctggctggcgggtagaatcttctcctggcagttcagggctctgcctccagctccctgggggagagcaactgagggaggagctggaggccaaggcctcagtgctgagctgcctgcaccgcagctgcaccttctgggtcctggctgcaggaaccccatacttctccagcctttccatggttcccgaagacctggcctggggagggggtcagcagcctggggctcacctacctggcttcaaatcctggctctaccgcttactcgctttgcgaccctcataattgacaaaagccctctcggtctcggtttccttatctgtgaaatgggacaataacagtggctaccttataggattgtgtgatgatccatcagttataatagctcctgagcagcgtttagagtaacacctggggctcggtgcagtggcttatgtctataatcccagcactttgggaggccaaggtgggaggatcgcttgaggccaggagtttgaaaccagcctgaccaacattagtgagacccactctctaaaaaaaaaaattagagtaacgcctggcacagagagcccccagtaaacctcggctgctgtgatgagctttgtttcttcatttgttcattcattcaccagactttttgccggggcttgccgtgagccctacgctgctctgaagaaagccgggctggggtgagcgtgatggatgaggtgtctggcttcacaaaccctgtgtgggggggttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgt

SEQ ID NO: 2 - DNA, 1405 bp, Homo sapiens
  source 1..1405: /mol_type="DNA" /organism="Homo sapiens"
cgttacccgagttgtaaagggcggctccctgtgtctgccccgctgcaccgatacaccgagctgcgcacggtgcccagcgcagggagaacaaatgatcatctgtccaacgcgcccatttacaggtgaggaaactaaggctccaactcaatcgacgcactctgcccttttgattaccagaaaagtagcaggacaggtgtcctgtcccgccctaccccggcccactaagccggcaccccggctccgacccccggctgtgcccggcgccgccgcggtgcccggcgccgccgcctcgcccggcggggccgcccggagcgcccgcacctccgcccgcttccacctggccgggcccgccccgcccggactcgggactgggaagtgcggcgactcccggaaccagccattggcgccagcgcggggagctgggggtgcagagctgcgggcgcggcgggccacgcaggcggcccccacccccggcctggcctggtctggtctggtctgcgctgccgcgcgggggcgccccctcccaggcccggcgcccgccagccccgctccgccaggtgcagcgcagcgcaggggtgggcgggggtggggctcggcgcgcacgttcacggggcggggagggggcgggtcaggggcgggaccacagccggctgggccggggttctatgcgcatctccggggaggggcggggcgggggcggggccggggcggggcccggtcggtgcactccagacggcgggccgccccctcttcccgccttcctactaccggcccaggattagcgccctgggagcgcgcgccccgctgcctcgccgccacactttcctgggagcggcggccacggaggcaccatgaagaagtcttactcaggtgggcttcgcgcccggggtggggaggggtcggtgtcccgggaccagcgctgctcacctgagtgcctgcggccgggagtggcgaggcgcccccggagctgagcgagtccccgcggcgggcacactgcaggtcgagttcctcccaggacagggccgctgtcgggccgctttcgacctgagccgaccgtcccctgcgctgtctccagcccttgctcgagtgtcggaggggctgccctgggggacgctccctcttcctcgccccttgcaccctcgcaggaatcgctgactttccaggtcggccgggtgctttgggtccctgtgcgtctgtgtgggtgaatggggtcggggctaggtggaggggtgtccttgggttcagcctctagggctggtggtccaggccgcagcatcctttcttcggattctcttcggtttctcctctacttagtggggcacgggacggcctccagatgggaccgtccagcagcgcccaaacttggcgactcgggttcacgttttgcgctcaggacgccgcccgc

SEQ ID NO: 3 - DNA, 2365 bp, Homo sapiens
  source 1..2365: /mol_type="DNA" /organism="Homo sapiens"
gtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgc

SEQ ID NO: 4 - DNA, 219909 bp, Artificial Sequence
  source 1..219909: /mol_type="DNA" /note="chemically treated genomic DNA (Homo sapiens)" /organism="Artificial Sequence"
cgttattcgagttgtaaagggcggttttttgtgtttgtttcgttgtatcgatatatcgagttgcgtacggtgtttagcgtagggagaataaatgattatttgtttaacgcgtttatttataggtgaggaaattaaggttttaatttaatcgacgtattttgtttttttgattattagaaaagtagtaggataggtgttttgtttcgttttatttcggtttattaagtcggtatttcggtttcgattttcggttgtgttcggcgtcgtcgcggtgttcggcgtcgtcgtttcgttcggcggggtcgttcggagcgttcgtattttcgttcgtttttatttggtcgggttcgtttcgttcggattcgggattgggaagtgcggcgattttcggaattagttattggcgttagcgcggggagttgggggtgtagagttgcgggcgcggcgggttacgtaggcggtttttattttcggtttggtttggtttggtttggtttgcgttgtcgcgcgggggcgtttttttttaggttcggcgttcgttagtttcgtttcgttaggtgtagcgtagcgtaggggtgggcgggggtggggttcggcgcgtacgtttacggggcggggagggggcgggttaggggcgggattatagtcggttgggtcggggttttatgcgtattttcggggaggggcggggcgggggcggggtcggggcggggttcggtcggtgtattttagacggcgggtcgtttttttttttcgtttttttattatcggtttaggattagcgttttgggagcgcgcgtttcgttgtttcgtcgttatatttttttgggagcggcggttacggaggtattatgaagaagttttatttaggtgggtttcgcgttcggggtggggaggggtcggtgtttcgggattagcgttgtttatttgagtgtttgcggtcgggagtggcgaggcgttttcggagttgagcgagttttcgcggcgggtatattgtaggtcgagttttttttaggatagggtcgttgtcgggtcgttttcgatttgagtcgatcgttttttgcgttgtttttagtttttgttcgagtgtcggaggggttgttttgggggacgttttttttttttcgttttttgtattttcgtaggaatcgttgattttttaggtcggtcgggtgttttgggtttttgtgcgtttgtgtgggtgaatggggtcggggttaggtggaggggtgtttttgggtttagtttttagggttggtggtttaggtcgtagtatttttttttcggatttttttcggttttttttttatttagtggggtacgggacggtttttagatgggatcgtttagtagcgtttaaatttggcgattcgggtttacgttttgcgtttaggacgtcgttcgcggttgatatttttattttattttagtagggttcgttttaagtaggcgaagggggtttgatttgggttttattatgagtcggtttaggagtttttattttataagaggttttcgttttggtattttgaagttttattttatagatgggtatatcgaggttataagggtaggttaagagaaatttagatttttattatttgtttttttttttttttttttttttttttgtggttttttttaaaggatttaggtaggtaggattttttgttttttttagtttttaaattataaatagcgtttttttttttaaatttagaaatcgtttgtttaatgttttttttttaatttatttagatagaaaggtatttgttaaggatttatgaattaatttttattgataggagaatagaattatgggttttagttggaggtgaaggagttatcggggttatttttttgtttttgggttattgtcggttttttttggttttttatatttaggaattaaaatgagtgataaagtattttgttttaaagaggattatttagaattttttcgaaaatatttttttgggttagtagtttagaattttaatttttattcggttgttgcgaataagatggttttttacgtattcggagtatagttttgttaggagcgtgggtgggttggtgtgttggtgggcgggagcgggtttttaggtggtatatgtttggttttggtatcggggttttttttttaatatgttttaaatatttgagattgttgtggggatcgcgcggtgtatggttttttttaggggatttttagttcgtttagggagggttttttgtttttggttttttatattttattttttattggtgggtttagatagtgggggtgatcggggtttttttaggtcgtgggttttgggttttttttgcggagatttttttgtatagatgtcggaagggttttgaggtaggtttggagtttttgtatttgcggtttattgggaggtggggagattattatttgtttttttttttttttttttatatatatttattttattttttattgggttttttttttttttttttttttaaaaaaaaggatagaattttttgtagtaggtggaagtagagtttgtggagtgagtaggaattaatttttgtatagtagtttcggtgtttttttgtgtttatttaaaggggtaggtttttttgaggatgggggaagggagggtttagattatttttggtttgttttttgtttggtagtggtttaaggtgtgttgggttattgtgttgtagttgtatggagtgggattggagggggttgatggtgggggtggttttttgtttttattttgagtgttttggagttgttttggtattagttttttttcgggtacgggtattcgtaggagttaggttgattttttaataagttatcgatattatgaaattaaggaaagtagtaaaagatgttaaaaattttttaaggttttgataatttaaggataataggaaggtttttatttttttatttagattgtgcgggattattgtttttagatttgtatgtgggttttagaataaacggaatgattataatgttgttttcggtagatttggtttgaatattcgtgagtttttgaaaaggagaaagattttagaaggatgtgttggggtaattttaagtatcgtgggtttatagatagttatcgaagatattttatgtgttgggtatatatggttaagtttgagtgggtatagaaatggtaatgagatatagtttttgtttgtagagaatttatatttttatcgggagttaggatgagggcgagatattagtttattaatattttttttttttgagtagtttagtttttaaatattataggaatgtttcggaggttttaggtggaggtgagattgagttgggttttgaggaaggagaagttttgagtagtggagaataaaaagggatttggttaggtgcgtttgaagttttagttatttaggaggttgagatacgaggatcgtttgagtttaggaggttatttaggaggttgagatacgaggatcgtttgagtttaggaggttatttaggaggttgagataggaggatcgtttgaagttaggagtttaaggttgtagttttgtgatagcgtttggaaatagatacggtattttagtttgggtggcgttatgagattttatttgtaagaaggttttttttaatgcggaaggtagtaagggtttatatagggtagttgtaggatttagggggatattggggataggttttttttggtagttttattgttgttttaggttttttcgattgttttattcggttttttaatggggtggaggtagtggtagtttataggtagtgtggtttagtggttatatttgggggtttagagtcgttagttttttgggattaaattttattaggttgcgtttttttttgtggtataaggtttttattttatgtattttatttgttttatttgtttttttgtgtgtgtggtgttttttaattttatttatttatttatttttgagacggagttttattttgttttttaggttggagtgtaatggtatgattttagtttattgtaattttcgttttttaggtttaagtgatttttttgttttagttttttgagtggttgggattgtaggaacgtgttattgcgtttagttaatttttatatttttattagagatggggttttattatgttggttaggttgatttcgaatttttgatttcgtgatttgtttgttttggttttttaaagtgttgtgattataggtatgagttattacgtttagtttgttttatttgttaaatgggatagtgttatgttgttgtaaaggttaaacgagtttatatttgaaaaagttgagaaatgtttgttttgtaatttgttagttgttgttatgattatgattgttattgataggaggatggagaaggttggggttacgttattgttaggacgttttagaagtttttatgatttttttttattgtggttagagtatggtgtagggttttttttttagttttttagtattggagttagttgtattgtattcgttttggttttttaggttttgagttttgggattttttttgtatattaggttatatggaatttgtcgttatttttaggtttttttggaaattttttgtgggtggtagcggtaggaggatttattcgaggtcgatgagttatagaagcgggattgaggttgcgttatatttttattggtatttgggaattattttggagattttttttttattttttatttttttgagatggagttttgttttgttgtttaggttggagtgtagtggtacgatttcggtttattgtaatttttgttttttaggtttaagtaatttttatgttttagttttttgagtagttgggattataggtatgtgttatcgtgtttagttaatttttgtattttttagtagagatggggttttattatattggttaggttggtttcgaatttcggattttaggtgatttattcgttttagttttttaaagtgttgggattataggtatgagttatcgtgtttagttattttggagtttttttgtggtttttaggagatttttgaaggggtattagttacgattaaaaagttttatgttgtcgtgatttttgagttttgggtagggagggaggttgtatttatataggaagtagtttttgtcgtgatttagtgtgttggttcgtcgtggtggatagggttgtatttttatttagcgtttcgggagttgatttacgggaagggtaaggaattgtatttttagagaatatttttttagttagttaattcggtgataggcgagcgtgggaagggtataagtatagggtttttttttttttttttttagtttcgttttcgcgtttgttttcgttgttttttgtttttttacgtttaagtttgtttgttttggcgtatttaggggatttggattggagagaaaaagttatttcgtacggttagtttgtggttttgtttgatttgtgtttttcgtcgaggttttttagttgtgagatagttggttgagtttaagttttggggttagttttttttttagtttgttgtaaaggtagaaaggtatgtttaggtaggggttatttgttttgttcgtttacgttagatcgtaggtatttgttcgttagattttttcggtttgtttagagggattttgatagtcgagggtaatgtatttggtagcggagtattgcgtttgcgatagtttattttttttttggaattattttttataagtgtgattagtttaagttaggataggtatagggggatttaggattgttatttaggggtagtggtttggaatttaggtttaggtgatatgggagttaattttttgtttggagattttaggtgggtgtttgtagaggatattttatttgaggatttatggaaggggatattttttattttttatttggtttttgggttgtttttttttgatatttttttgttattttaggtagttttgatagttttatgtgattgggatttagaggtggtttttgttttcgttttagtgtttgtttataggtagtgttgcgtgggttttgaagtttgtttaagatggatttgataaggggagtttagtatatattagtgtaggttcggttagggggtgatgatggtagtttttgggtagatttagttggttttagggtaggaggggttttagagagaggttttaggtttttaggggtgtgaatttttggggtgaggcgggaagtgacgcgttgggtttttgcgtttttgtttgttggagttattattttggaaatattttagttttaggcggttgttagggatttatggggattagtgggtgttaatttttgggtgaagttttcggggtttgtatatagtatatagcgttgtggttttatggtttattttgttgtgtgaagtggtttagttttcgggagagtttttagttaggtaggtttgacggtaattgttaggttatggtgatttggaatcgttgattaaagggagttagttttggtgggtggagggatttggtgggtagttatcgtgatgttaggtatggggatcgtgtgttatttaggtttgtgggtgtcgagtttttgtgggagtagtgaagtgttttcgtggtcgatgggttggttatttttgttttttttttgatgtgatagttgtgtttgggtttcgggaaatttgttaggaggtttggtattggtttgttttattggagcggttttgttgagttgtgagttgttcgtttttttgaggtttttagtttattttaattttttatgtggatttggttatttattttagaagcgtttgtcgggcgttgttgagtgttaggttttgtttgtttttttttttgtacgttggaggttttgggtattagttttgtagggtggtttggttttgggtttttagggtagagtatggtattttttgtttttagtttagtttttttttgttttatttttttgattttattttgggtatgggtttatttgtagtttttgtgaagggagatattgagttgttgttggtagaggaggggcggtttttgggtattgtttgttaatggtttttcggtagttttgtgatagttgagttttgtttttagtttaatttgatttggttttttaaagtatgattgttggtagtttgaaaatttttaggataggaaataggagtggcgtagggaatgtaagatgattttagttttaagttattgggcggtttttagatttaggttgtttgttgtttttggtaggaatttaagtcgttggttatttttagagcggtgttggttcggggtttttagtggtttttgtgtttgggtgagaggaattttggatggttattttgttttgagtgtgtgggtttttagaagtgttgggttagggggtacggagggttagaaagttttttttggagcgttggattttttcgttgatttttattttatttcggtttggggttttagagaaggggtttaggtaggagtgttatttttttttaatggggatgtggttttagtttttgtttaggtgggtgtattgtttttttttcggttttttttaggttgtttaaatgatttgtgacgaggtttgcgttatggtcggggttttttgttttttttagcgttgtatttgggaattaggggttgggtttcggaagtcgaggatgtttttgaatgttatgtttgggtatttgttttggttaggcgaggcgtgttggggtagcggttgagatgggagtagtagtattgtttgttaggtttgagatgggtttcgggtgagtgtggttattaggaagggttgggtagagtaggcgggtgggtcgtttttggggttttgtttcgtagattaatttgattcgtattttggggtcggggtttttttttatagtttttttatgaattatggtttttgtttttattttaaattagattttagaagaggaataatgtttatgtaatttaagttagttggaagtgggttatatttaatttttgttattttttagtttgttaaggatttgattaatttaatttagagggatttggagggttgtttgtaaaatttattaataatagggaattttagttttgtagttatagggtttatagaggtgtcgggttgtcgggttattgttgggaggtgagtcggtggcgtagatattatggaggtatcggtagtggaagagttgtaagtgtatatagaggtcggtatcgaggggcggggaggaggaggtggtggatttttcgttagtgttggtattatgttgtttttagtattagagatttaaggtgtggttgattttggttggggcgatgagttattggatagtagagtttttttggtagttgggggttaacgttttaattgtcgggattttgtattatgtcgttttttttttttgttttgtttggtttggtttggtttggtttttgagacggagttttattttgttatttaggttggagtgtggtggtttaattttggtttattgtaatttttgttttttgggtttaagtaatttttttgttttagttttttgaatagttgggattataggtacgcgttattatgtttggttaatttttgtatttttagtagagatggggtttcgttatgttggtcgggttggttttaaatttttgattttaggtgatttatttgtttcggttttttaaagtgttgggattataggtatgagttatcgcgtttagtttgtatttatgtttttttttttttttttttgagatggagtttcgtttttgttgtttaggttggagtgtaaaggcgcgattttagtttattgtaatttttatttttcgggtttaagcgatttttttgttttagttttttaagtagttgggattataggtttgcgttattatgttcggttaattttgtatttttagtatagacggggtgtttttatgttggttaggttggtttcgaattttcgattttaggtgattcgttcgttttggttttttaaagtgttgggattataggcgtgagttatcgtattcggtttatgttttttattattattatttaattttttaaggaaagtaatttaaattgtatattgtatttttttttttttttttgttttttgttgttagttttttgtattatttattgttaaataatatgaataggaaattgaaaggaaaattttaataattattggttgtagtattttttttgtgttttatttagtgtttgtttttttaggaatatgatatagggtttgatttaattatgaaaggcgtatatttttagagttttatattttttatagaatgaatgttgaattttgttttttttatttgaaattagattttaggtatggattttatgattattattataatggttttttagagtggatattgtattttgtagggaattattttttttttagttgttggtgtggacgtttttttttgatggtgtgggtttgggtttttgaagggtggtgttttgagtaaagatgttatagtagttatgtttatagttttgggtttggggttaggtggagattggttttaattttagagtttgttgttttaaaataaatttttttttttttttttttgagatggagtttcgttttgttgtttaggttggagtgtagtggcgcgattttcgtttattgtaagtttcgtttttcgggtttatattatttttttgttttagtatttcgtatagttgggattataggtattcgtttttacgttcggttaattttttgtatttttttagtagaggcggggttttattatgttagttaggatggttttaattttttgatttcgtgatttattcgttttagtttttaaagtgttgggataaaataaatttttagggtcgggagcggtggtttatatttgtaattttagtattttgagaggtcgaggcgggtagattataaggttagaagatcgagattatggtgaaatttcgtttttattaaaaatataaaaaattagttgggtgtagtggcgggcgtttgtagttttagttattcgggaggttgaggtaggagaatggtatgaattcggaaggcggagtttgtagtgagtcgagattgcgttagtgtattttagtttgggcgatagagtgagattttgttttataaataaataaataaataaataaataaataaatttttatatttatttgtattatttattattattattattaaatagggttttgttgtgttgtttaggttggagtgtagtggcgtgattatgattttttagtttcgattttttagttttaattggttttttttttttagttttttgagtagttgggattataggtgtgcgttgtatgtttggttaattttttttttttttttttttttgagatagagttttattttgttgtttaggttggagtgtcgtggtgtaatttcggtttattgtaattttcggtttttggattaaagtaatttttttgttttagttttttgaatagttgcgattataggtatgtgtcgttatatttggttaatttttgtatttttagtagggacggggttttattatgttggttaggttggttttaaatttttgatttcgtgatttatttgttttggttttttaaagtgttgggattataggtgggagttatcgcgtttggtatgtttggttaatttttaaaaaatttttgtagtagtcgggcgcggtggtttatgtttgtaattttagtattttgggaggttaaggaggtcgggagttcgagattagtttgattaatatggagaaattttgtttttattaaaattataaaattagttgggtatggtggtatatgtttgtaattttagttatttaggaggttgaggtaggagaattgtttgaatttaggaggcgggggttgtagtgagttgagatcgtgttacggtattttagtttgggtaaagagagtgaaatttcgttttaaaaaatttttgtttttgtttttgtagcgatagggttttgttttgttgttgtttaggttggtattgaatttttagttttaagcgatttttttgttttagttttttaaagcgttgggagtataggcgtgagttattgtgtttggtttttatttgttttggttgtttttttttgttttaggtaattatatatttttttaggtaattaagaaaagattgcgtatgatgagttttttttttggtatttttgggattgtttttaaaattagataagtgtttttattttgatattttattaagattttaatgaatagaatgtcgtttgtttttagtttgttggtttttttgcgaaggtttagggtttttttgtttgaaaagttatttttttgtcgaggtttttgatttttttttattacggtagttatgtcgagggtttatagagttattttttttttatttttttttcggttttttaagacgtatttgtattttcggagatgtttttttgtttttttgggttattttttttggtcgttatttattttgttgatttattatttgtgtaatagttttttttggaatttttaggtttttgttatttattttttgtagttttcgttttgttttttttgttttagtttttttttttattatttttttatttgttggtttttatttttgtttatggtatatttttgtgttatattttgatggttggataaaggttgagtgaaacgtatttatttttttggtgattggggtgtttattaattagaagggatttaaggttggcgtagttttttttcgtattttggggtatcgttttgtggtttttttttgttggagtttgtagttttttgtttttttttttttaaattttttgagatggagtttcgttttgtcgtttaggttggagtgtagtggtgagattttagtttattgtaattttcgtttttcgggtttaattaatttttttgttttagttttttaagtagttgggattataggcgttcgttattatgtttggttaattttggtatttttagtagagacggggtttttttatattggtcgggttggtttcgaatttttgattttaggtgataggttcgcgtcggttttttaaagtgttgagattacgggtatgagttattaggttcggtcgttgagattatttttataagttattaggtttggttgtagttggtagtttttgattattggtttcgttttacgtgatttgtgattttttttttggttttttggttttgttttgtttatttgtttattttttttatgtatgcggtttgtttatagggtatgtaatggggtttaattaggaaatggaaatcgtttgagtatttatttatttatttatttatttatttatttatttattttttttaagataaggttttattttgttacgtaagttgaagtgtagtggtgtgattatagtttatggtagttttgaatttttgagtttaagcgattttttttttttagttttttaagtagttcggattataggtgtatattatatgtttgtttaatttttttttttatttttgtagagatagggttttgttttgttgtttaggttggttttgaatttttaattttaagtaatttttttgttttagttttttaaagtattggagttataggtatgtgttattacgttttgttaatttttgtattttttgtgtgtgtgtaaagataaggttttattatgttgtttaggttggttttgtatttttgggtttatgtgatttttttgtttgggttttttaaagtgttgggattataggcgggagttatagtgtttggtttatttgagtatttagaatagaaggatttaaaggcggggaattagttatatagatgatgggagaggtgaaggttagatagggaatagagaggtaattagtaggaaattaaagtggtgtgggtttatatagttttttaaaggtatggatgtaatgatttatttagaatgagaaaataaataatagtaaattataaattataagtagttgttaaatattataaatattattatatgtagaagagtattagttaattgttagttatatttttaaagttttattttttttatatttttggtattatttttttaatatgatgattttgtaatatcgttttttatttcgagaatagaaaattgattaggttggatatagtggttcgtgtttgtaattttagtattttgggaggttaaggtaggtggattatttgaggttaggagtttaagatcggttcgggtagcgtggcgaaatttcgtttttattaaaaatataaaaattagtagggtatggtggtatatatttgtagttttagttatttaggaggttgaggtgggaggattgtttgagtttaggaggtcgaggttgtagtgagtcgtgattatgttattgtattttagtttgggtgagagagtgagattatgttttaaaaaaaaaaaaaaaataataaaaaaaaatataggttgggcgtggtggtttacgtttgtaattttagtattgtgggaggttgagatgggcggattatttgaggttaggagtttgaaattagtttggttaatatggtgaaattttatttttattaaaaatataaaaaattagttaggtgtgatgacgtacgtttgtaattttagttatttgggaggttgaggtaggagaatggtttgaatttaggaggtagaggttgtagtgggttaagatcgtgttattgtattttagtttgggtaatagagtgagattttattttaaaaataaataaataaataaagcgaatgaatttttttagttgattaaattttgtttttatttttggtagttgggatgtatataaaagtggcggttaatatggagttggtggtgttgttataattgttttgtttaagatatataggaattttggtaaattttgtttttttttttttttttaaatgtgatttttattaagaaagaagtaggaaaatgggggagatttttaattgtatatgaggtatttgtgtatgtatttttgattagagagatttttttgttttgattttatattgaaggaattgaattttttgtttataattttatttttggtgatgggagtaattttttatagatttgtttttggattcgtgtattttaaattttgtttttttttattgcgtacgttttttcggcgttaggtatcgtaggatatgttcgtgttttgtgatttttgattttgcgcggtaggtggaattggaacggtgagtggagcgagtattgttggaattcgtttttatatcgggatagcgagtagtaattgaattatatatggaaataaatgggaattatataaatataattcgattaaagttaaattaaatatttttttagtttaatttttttttagtaggagtttttacgtggtagtaagttttcgtttttattttatataagagaaaatgtgacgggtaggaatttaagattggaaatgaacggggacgttaattgattgtagggaaaatattttttattttgtaaattttataaaaaatgtttgattttgtggatatgtggttagggttttttttagtgttttgagagggaattatgtaggtagagggagggtttttagtattgtgggggtgatttggagattggtagtagggtgttattattatttttaggtggggatgagagggaggaagttttgtgattagagtttaggggttagagttatttgttgggagtttaaataaaggtgggattttggtaggagttggaattatatagaggattattttttttgttggagaagttgtttgaggtagaggaggtggagagttttcgcgtttttttttgtttttattttttaggttttttttaagtttttcgttggttgaatttagtttaaagttagtaggtttggggatttggatatttgagttagtagaggtcggcgttttttttatataaaggagggtataagaagtgggaggtacggagggggattaggttaggatttatataggatgtgtaaataggagtttttttttttttttattttaaatggtatttgtagtcggttttatttttttgttgttagataggaagaggaattttgttttcggtattagttgtttttatcgttttttattttacggaggttttttttttttttggtttttgtttgtaattattggcgacgttgatggattatattttttggggagtttggttatgaatatggttttttatttgttgtggattaaattgtgtttttttttttgaatttttgcgttgaagttttaatttttaatgtagttgtaattgaagatagggtttttagggaggtaattaaggttaaatgaagttatagggtaggattttaatttaataggattgatgtttttataagaagagggagagatattagagattttttttttttttttatttgtaaatagaggaaaaatgacggaggatatagtagggaggtgggtataagttaggaagaggggtttcgtcgggaattaattttgacggtattttgattcgggattttgggttttttaaattgagaaatatatgtttgttgtttaagttattttttttatagtaatttggatggtagtttgagtttattaaggtatcgtttgtattagttagggttttttagggagatagttaataggagatggatggatggatggatggttagatagatagataagcggatagagagagagagagataggtagatatagatagataggtagataaatggttagatagataagtagatagagagatagagatagatagatataaataggtaaatagataggtagataaatggatagatagatgatagatagttaggtaggtagatagatatagataggtagatagatagatagatagatgataggttgggtttagtgatttttatttgtaataattagtatattggtaggttgaggtcggtggattatttgaggttaggagtttgagattagtttggttaatagggtgaaattttatttttattaaaaatagaaaaattagttgggcgtggtggtgtatgtttgtaattttagttattcgggaggttgaggtacgagaattatttgaatttgggaggtggaggttgtagtgagttgagattacgttattgtattttagtttaggcgataaagtgagattttattttaaaaagaaaaaaaagatagatagatgaatggatagatagttagatagatgatagatggatgataggtagatagataattgataaatagatataaatgatcgatggataggtagatatagatatattgattaggtagatgatagatggatagatagaagatagatggtggatgggtgggtagataggtagatagatagttagaaagatagatgatagatagataggaaggaatttattaggggaattggtttatattattgtggaggttaagatgtattatagaaggtcgttcgtaagttggaggtttaggaaagttagtatcgtggtttagtttaagtttgtaggttttaggattgggaagttgttgatgtaatttttagtttaaggttaaaggtttgagagtttggggaattgttggagaattgggagttttaagtttaagggtaggagaggaaggtattttatttttaggagaaagagggaatttattttttttttgtttttttgttgtttggtaatggaatggtgttatttatattgagggaggatttttattatttagtttattaatttatatgtttattttttttagaaatatttttatagatatatttagaagcgatgcgttattagttattttttaatttagttaaattgatatttgtcgttagttattatataggtttagaagaatcgtggttgtatggtgatggtttttatttcgtttaaagaagttgaagatgaattgttggtataagttatcgtttttttaggttttttttagtcgtttatttttttaaaaatgtatttattgagtatttgttgtatgttaggtgttgtgataagtattggggtatagtagtgagtaaataaggatttttgttttttggagtttatatgtagtagaaggaaatagaattaatgaatttattagttttagaaattattaaaataggattaagagttgtggtgagaattaagataaggtgattgtatagaaagtgattgatggttgttttggaatgagtggtgaggggttatagagatgatgatagttgagttgagattgggaagataggaaggagttagtagtgtaaggattaggttggaagtaagtttggtgtattttaggaatagtaaggaggttagaggggttgtagtagagtaggcgaggaggaggagggagacgtaggttaaagaggagtttggggttagatggaggattttttttttaaagtttagttattttttttttaaaggagaatgtgttatttttaaaagttatatatgttagtatagtgtttggtttattatatgtttttagtaggcggtgagtatggttgtttttgttattattatattataattattaggaataatggagttattaggttttgtatttatagtaatgtgagggagttagtaagtttttttggggaatttatttttttttattaagtttataagagtttgataattaggttaatgtagtgagagttatagttgtttagtgtattggattttttagttacgggttaggatatttttattttagtagaaatttttaaggggattggggagtgtgttgtggatgtttttgggttatttagattttttggggagttttttttatcgtagttgttgtagggagtttagttgtagtgatgaattgcggtttagttttgtttatgggaaaattttatatgggagatgggacggttttttgttggttttttcggttttaggttgtttttataagtgtagggatttttatttgggtgtgtgaatggggtttaggatgttttaagggtatgtggagatgggggttagttgttttttttgatgtttttgaattttttttttttgtttttttgtattttattgttttttggttttttttattttgggtgttttggaataatatgtaatttaatatataggttgattttattattttgttttgttttattttattttattttggaaataaaggttttgttatttagtttggagtgtagcggtgtaattgtaatttattgtagttttgaatttttgggtttaagtgattttttcgttttagttttttaaagtgttgggattataggtatgagttgttgtgtttggtttaggttggttttaaaagttttttattttttttgtattttgatgatatttattttttggagtaggtttttagttattggtttcggatattttgtagttattattggttagttgtggtatgtgaagttgaggtttaggagaagggtagttttgtttaaggttatacggtttagtgttaatatttagattttagtgtttttattttttttttggtcgtttttatttttagtgtatttttggaggtttaagggagttaaaggttaggttttggttagttaagaatttaaaaaagttgtttttgtgtttttttgttaatttattattttattatttttttcgataatgaatttagtttgaattttagataaataaggattaatttttagtataagtatattttataatagatttgggatatatttatgtttaaaaatgatttattgtttgttggttttagtagtttatgtttataattttagtgttttgggaggttatagttggagaattgtttgagtttaggagtttaaggttatagtgagttatgattatgttattgagttttagtttgggtgaagtagtaagatttttatttttttaaaaaattgttgattgtttatttgaaatttaggtttaattgagtattttgtattttatatgagaattttatataggtgagatttagagttttaatgtttattggtaagtttttgtagggaggttttgtgggtttttggttggtattgatgttttgtgatgagtagggttatttggtaaggtggacgtttgttgtttatgtaggtagagtaaggttttgggtaggtatgagttgattttattttttttagtttgggagttagatattgttggtagtttgtcgttaagagaggggttggttattaagagaggggcggtttttatgggttttttttggtttttggtttttttttagttttttttttattttaaatagaggttaacggtatcgtattagaattagtgtgttgttttttttggttggtattttgtagttgggtagattgttttttttttataggagttggtggtgtttttttcgttttatagggaggatggttgagatttttgattttgatatagggtgttgttttttttttgttttgagatagagttttggtttttttatttaggttggagtgtagtggtatgatgttggtttattgtagtttttattttttgggttttagtaatttttttgttttagttttttgagtagttgagattataggcgtgtattattattgagaataatgttttttatagtgtttatttttttgtaggagtaagtttttaaggtaaggaggttgttttttttatggatgaataaattgattttgatttatagttttacgtgttagttttgagggtggggaaaggttgttttgtgtttaggtagggggtgggggtaaggttaggagggtttggtgtttagtgtatttttttaggatataattttaggtagtagaggttaaggatagaggggaggagaagagggaggtggttattatttttttattttagttttttttggagataagtttgagtattttagttgtttattaagtttggagataagtttggaatttaaatttttgattttgatttagttttttatagtttttgtgagtaaattgagttttagaaaaagggagtgaagtttgtgtattttggacgtttttattttaggtttaaatcgtttttattttaggtttaaatcgtttttattttagtttaaatcgtttttattttaggtttaaagcgtttttattttagtttaaagcgtttttattttaggtttaaagtgtttttattttaggtttaaagcgtttttattttaggtttaaatcgtttttattttagtttaaatcgtttttattttagtttaaattatttttaatataggtttaaattatttttaatttaggtttaaagtatttttattttaggtttaaagtatttttattttaggtttaaagtgttcgtaatttaggtttaaagcgtttttattttagtttaaatcgttttattttaggtttaaatcgtttttattttaggtttaaattatttttattttaggtttaaatcgtttttattttaggtttaaagtgggaaggagttatagggaaataaacgggggaggtacggatgattaggatgagggtttttatgatttatttttttttaggggttattttaagagttttttaaatttttattattttttaatagagatggggttttgttgtgttgtttaggttgatttttaatttttagttttaagttatttttttattttagttttttaaattgttgaggttataggtgtgagttattgtatttggttttttttaggagttttaagaaaaaaaatgggaatagatttgtgtgtgtgtgtgtgtgtgtgtgtgtgtgtgtgtgtgtgtgtgttttgagaaagagtttcgttttgttatttaggttggagtgtaatggtacgatttcggtttattgtaattttcgtttttcgggtttaagtgttttttttgttttagttttttgagtagttgggattataaatatgtaggttgattttgtatttttattagagacggggttttattatgttggttaggttgatttcgaatttcggattttagatgatttgtttgttttggttttttaaagtgttgggattataggtttgagttatcgtgttcggttaggaatagatttttttttgtagatgatttttgttattattgaaaatggatgtttatgtataattgaattgttataacgttttattttaaaaagtttttttttgagaaaatgtgatttttgatagaggagagattgtttaggttttatttattgttagtataaaggtagagtaggggtgtggcggtgttatttttttttgagatagttttatttttgttttgtttaggggtttagaagtttggtttattcgagtttatagaggggtttggagtggttgttttatattataggtggggtttgtaaggatttgaaatgatttttgagaaggcgggtgtggtgggtgtattttaattattaaagtaataataatgatatattaaatagtgtttgtttagattttgagtgtttgtttaaatatttttattttgtgatttgttagattttagtataataatttaggtaaaagaaaaaatagttgggcgtggtggtttgtgtttgtaattttagcgtgaggttaaggtaggaggattgtttgagattaggagtttgagattagtttgggttatttgagattttatttttgaaaataaataaattaataaaagatttttatgttttatgttttttttatatttaggttttttaaattatatgtattggggaaagtttattaagagaagtttttggtcgggcgtggtggtttacgtttgtaattttagtattttgggaggttaaggtgggaggattataaggttaggagttcgagattagtttggttaatatggtgaaattttatttttattaaaaatataaaaattagtcgggcgtggtagtgtatgtttgtaattttagttacgtaggaggttgaggtaggagaattatttgaatttgggaggtagaggttgtagtgagttaagttggtgttattgtattttagtttgggcgatagaaaaagattttatttttaaataaataaataaagggagagaagtttttgggtttttagatatatgggttagtgtttatttttgtaaagttgttgtgtttaaagaggggttgtatttggtggaattggggtaaaagagtagggagggtattgggtagttgatttggtttttattattggaaaggggttgtgttgttggtgttttgagttggttttataaggaagatattgtatagggcgttttaagtttgttttttttgtttaggtttatttttttttttttaggattagggagtttcgttcgttttttgttttcggtatttgttttttggtttgtgagtattgtatttttttttgtttggaacgtcggtttatggtgggttttcggatttttgttttttgttgttttttgttatatttcgttaaagtgtgttttatttatttattgttattattttttgaaatagagttttgttttgtcgtttaggttggagtgtaatggtgtgatttcggtttattgtaattttcgttttttgggtttaagcgatttttttgttttggtttttcgagtagttgggattataggcgaatgttattacgttcggttaatttttgtatttttagtagagatggggtttttttatgttggttaggttggtttcgaattgatttcgggtgattggtttacgttagttttttaaattgttgggattataggcgtgagttattatgtttggttaattattataatattgatattataataatattatagttagataacggtgattaacgtttgtaattcgaatattttgggaggttgaggtaggtagattatttgaggttagttcgagattagtttggttaacgtggtgaaattttgtttttatcgaatatataaaaattagtcggagcgtgatggtaggtgtttgtaattttagttatttgggaggcggaggttgcggtgaattgagatcgtgttattgtagtttaatttgggtgatagagtaagattttattttaaaagtagtaataataataataataataataatattatttattgagttttaattttgtgttaggtattgtgttagtatttgcgttatgtgattttattgattcggaataatttatgagtaagtattatttttgtttttaaggaagttgagatttaggaaatggaagttattttttagggtttatagtaagggtttggcgaggtttgcgtttaaattttgattatttgattttaggtttttttgttttttttgttttttaaaaatttaaatatttttatttgggatgattttagatagttagattttaattgttttttttttttttgagtatgttttattttaaaattatataaagataatttattttttaattggagttacggaatcgttagatgttttggagatttttttagttatttttttgttggatttagatataggtttgaataattaggtttaaggagttgaattggagtcgttcgtggttagaggtttttttttgggaatagtagtggcggtagcggttgcgttgagtttggtaatttgtttaagagtaggggatgtttaggttgcgttcgttttttttttatgaacggtttgttttgcgttttttttgtgttaagggttgttaggtattagatgtttattttaggaaattagaaaaataaatagtgtaaataaaataaaaattttatttaagaaatttgagatagatgttgttttttttatcgtttttttatttttatgttgggtttggagagagtgggttagtatgttttttacggataagaggttttggggtatttaatttggatggaattttttttattttttttttgtttggtgttagggggtagaaggtaggggtggtgtttatttggtttagggaggaggatagggtagtttttgtcgtcggtattttttgtagagatgttttagttagaagtgattttatttttaggaacgtgtgttttgttttttgttgggcggtttttttttattttttattgtttttatagtggggtgtgttagatttatgggtagagttttggtttatttttagtttcggatagtagaatgttttagtagtgtattgatggtgtgtgcgtggggatgtgtggaataggggatagtgatttcgtgtgcgttatatgtagtgcggtttttagtcgggtgtgtgaagggggtgtttatggttatcgtggaagtgagtttagttggggttggagggtttaggtttattgtatgttatttagtagttttgggagtggggtttattttttttttcgtttttttttttttttggttttgggtagtttatcggagttgtattttgggttattttttttggttttaaggaggttgttatttttgggaggtagatgttggtttttttatttttgttttttggagatttgcgtcgaggtttgtttttttgtttggagggattggttaggaatttttgggtttttttggtggggtttttgttgtttagtagtgagtagagtgagtgggtattaagaggaggatgttgggtgaggttacggatatggttggggtaggttgggggtgttggaggtgaatttcgtagttgtgcgattttgggtagtttgtttagttttgggtttcgtttttttttttatgaaatggggcgggagtatttgtttgttggggttgtgggttgggtgaatcggagttaaggtatagtttatagtttgtcgttagattttcgtaagtagaagtgggtgtttttgtttagcgtttttcggttttttttttaaggtttagttttgtttttattttttttatgaagtttttttggttattttaggagttacgatttatattttttttggagttttgtgttatacgtattttttacggtgttgttttttttggaggatgggtttaattaaaattggggtttatttgggggttttttttagtattagagaagtttaggtttagtagagatgggtattttgttaatattagtttcgcgaaggatatattgtgtttattttgttgttagttgttgagtttggtgttttgtagttatggaatatgtgtataggtttgggttgttggatacgaaggttagatgggtagtttattttgttttcgttttgagtttttagaaataagttggttgtatttatttttatttggttatagtttaggagtggggttgtggaatggatggaaggaaggatgagtgggtgggtgggggggtgggtgggtgggtggatggatggatggatgatgggtggatgggttgatggatgggtggattaggtggataggtgaatggattggtgggtgggtgggtgggtgaagggttgaataggtgggttgggtggatgggtggatggatgtgtggaggggtggtggggtggatggggtttatgggtgaatggatggatggatgggtgaatggagtaaatgagtgggtggatggatggatggatgttgtaagagtttttttggagggttttagggaggaattggtatttttgattagtagttagtatggtgattagatatagggaggtgtttgggtttgtttgattttttattttattgttggtgggattgggttggttatgtgtttttgaagttttttgaagggtggttgtatggtattgtttaggggatatttttagagtgtcgtgttttatagtaatagggtggtcgtttgtgtttttagggtcgttttttttggtagtttttcgggtttgtttggtttagtattttagtaaattttttcgagttaggatttgtttgttatgagtttttttaataagtagttttaggttaaggtttgtgtgtgggtagagggagcgtatgtcgcgggaggttgtattaatttgaggttttgtttttgtttttttttggggtaaaaggtaaaaatagtttgttttattttatttttaaatttagttcggttgtatttagttttgggagtgaagggggttgggttaggattgttcgtgagttgtagattttggtgtagggaaattttgatttataagacgggtggatatggaggaaggaggagatttcgtttagtagagatacgtttgggtgtagtttagtttggagtttgatggacgtgggtttatttgtgtgtaatttttatttattgtgtggttatagggaagtgatattttgtggagatttagattttttatttgtaaaataggggtagtagggtttgggggaggatgtgtgtgaaggtttggtttagggtttttttagtagttagatagtagtggttgttatttttttagcgtttagggttatttgggggagtagggtttttgtttttagatgggtttcgtttttggttttggaatttatagtaggagtaaaggcgaggatatttttggtgttaattatttattcggagggagagcgttagtggttttgtgtgatttttgttttttgtttttgtttttaggaggtacgcggatttttagtggtcggtttcggaggtttggtgattttagtggtttaggtaggtggttcgtttcgttttggttttatttagtttatgggtgtgtttgtgttggggtttttttattttggtttgggatttgtttttttatttggtttttttggatgagtggggttatttgtttattttttagggagacgtagtttttgacggttttggatttaggtggtttttaggtttgtcgacgttgttttgttggagatgatttttgtgggggtaggggtagttatttttaggtttagggagtaagttcgtgtgtgcgggatagaggagagaataggagatagatagggttggatgatttggtttgagatgttgaggggatagatgtgttatggataggtggttttggtcgtgagtttttcggtgttggtttagtatttgtgggttttttgtaattttgtaggatggaagatgttttaggatagagtagatacgttcggtgttatttaggaggaaataagtgggtttttggtagtggttattgtgttattttttgtgttttttttatgtgtttggaaattttttatattaattagtagggaagggaaatagatgtatttattagagttttggggttggtcgtttaggatacgagttatagtttataggtttgaagggattttattaatattgggtgtagtttgggtaagggagtgggatagagaggttagggttttgtttttagtttttgttttttagggttgagtttgcgcgttattttttttttattgggtgtttttgattttttttgtttgattttagtgtggttatgttagtgtttttgtttttgggagtttacgttgtttttggttgttatttttagcggttaggttgggataggtgtttatttagtggtttttttatttggagaggatgatgggttatagtaatgaatggatttattttttttaggagacgaggagttttgagaagagtagagatggcgtggttatttgtgtatatgtgttgggggttaattgggtgttagatttttggttgttattatggtggtagataggtagggattgtgtttttatgaattagttattttagaggagataaagttattaaaggatacggattcggagttaaatttatataaatagagcgtttgtggattagggttgtttttagaataaggtgagatagtcgttttgttaggataaggcgtttacgggggtaagggtatgtgtttatttggagtcgttatttttatgttttagattagtttcgtttaatagaattttttgtgatggtgggtttgttttatatatttgtatttcgttattttgtatggtagtcgtttagtcgtttgggtttattgtatatttaaagtataaatgtttacgtttattttatttatttatttatttgtatagaattatttatttattttaaatggatttttatttatatttacgtgtggttagtggttatgaaattgaatagttttagattatattggtatttgagattttagaattttagatttaaagtttgtttttgattttgagtttgtttttgtggggatagtatagacgttttttaagtttgttttttagaggtggatgtagtgttcgtggattgtgtattattaggtttggatagtggagagggtggttttttatagggagtgggagtggaggggatgtcgtgtttatattgagtgtatgtgaggttttttgtagtataggatgggattgtatgtgggaagaggggggtgatgttttggttggaggtttttgggtagttgtatgatttagcgttgtggttaagaggggtttcgtttatcgtagttatgttgggtattaattattggatagtttagtcgttgttgtgtttttggggagttttttttcggtttcgtatttgatttgtttttttattttttttttttttattggttagtttttggtggaatgggtggggagggttttttagtttttgtgggggttgtattttgggaatttggtattttgggttgtatggatatagtttttttcggcggttgtttttttttgtttagattggttggttttgtgttgttagtatttggtagttacgattatagtttagtttggaagtttaaggtataatttgttgaattttaaagttgtaagttggtgatttgggtttgcgtgggattgtttgttgatatacggggttttttttttgtgggtttttgtgggttttggttcgagatattttttttttatttttttggtttttttttttttttttgttttttttttgttaagattttggtttaggtaggagtttatttttagacgttttagtattttcggtttttttatttgatattttttagacgattgtttgttattttatttttttagtttagtttttttgtagatttatatttggttaattttttatgtttgggatttttgttttttttagaaggacgaaggtttttttcgaggttgtgtttgggattgggttagggatgatatttttggtaaaagtttaaatgatattatgattaacgttttggttagtttatatattttttttttttttaaaaaaaaaatggaatttttagagttataaaataaaaatgtaaagaataaggtaataaaatatttgtgtatttattatttcgtttaagaagtgagatattgtaggtgtagtcgtagttttgggtgattttttttattttagttttatttttgttgcggtgttcgtttttttggattgggatttggtttcgggtaggtatatttgtgttgggtagtggtgtgtttgagaagtttaggtttttttttttttttttttgagatagagtttcgttttatcgtttaggttggagtgtagtggtattatttcggtttattgtaatttttgttttttgggtttaagcgatttttttgttttagtttttttagtagttaggattataggtattcgttattatgtttggttaattttttttgtatttttagtagatatagggttttattatgttggttaggttggttttatatttttgattttaggtgatttatttgttttggttttttaaagtgttgggattataggtgtgagttatcgtattcggtttggtttttttttgtatacggttattagtatcgtgtgattgagtagtttaggtttgtttttttttgaatgtcgttattagtattatatttttggtgttttattggagttagtggttgttttgtttgtgtttataacgtgacggcgtggagatttattcgtgtagatttacgaagttttggtttatttattttggtagttagcgagtgtttttttgtgtggggaggtagagtttgttcgtttcgtggtttattggtgatatcgtcgaaggttttttttgttattagtgttgtcgggaacgtgtgtttttttaggtggatttggttgggttgtggagatgcgttttttagtttttttagatgttattattacgttttttcgagtggttttttggtaggtttttttatgttcgtttattttttgtgttttaggtagtcgtttttttgattgagcgtttagcggatttttgttttgttttttacggtgtacggagtattttattttagtggtgtttgagtttttttttttttggtttttagatttcggttgggatttttggagttaatttttttgtttgatatttcgtgtcgttaggttttgtttttttattttttaatatttttggggtgtgtggttttttttttagtgtttttattattttttttgttttaggttgaatcgtgttttttataaatttatgtttattaaaaattttagaatgtgatttgggagttggagatggggtttttgtagatgtaagtagttaaggattttgagatgaggttattttggattagggtgggttttaaatttaataattggtgtttttaaaagaagtagagaggttatagatatatcggggagagttacgtgaaggtaggagtagatgatggagtgacgtagttttaggttagggagcgtttgggaagaggtaaggaaggattttttttttattttattttagagtttttttagggagtgtggttttgttgatattttgattttggatttttggtttttagtatgggagagaattcgtttttatttttttaagttttatagttgtggtttattatggtagttataggatattgatgtattttttatttggtcgttgtggatggacgatttcgttcgtaggaagttttttttaagtattgtaggtgtttttgtttttataggggacgtttgtataagtaggtgtgaaaaaagggttttgtgggggtaaggtttgggttggtgttcgttgtttttttttattttatgttagtttttatgtttttttcggtaggagtgtttggttttatttggtgaattagagttaaatttttttgataattggttgttatttatttaattgttattatttttaggagatagaaaatgttagaagggtggggtttgtgtagtgttttttcgttatttttttagggtatcgtgttacgttgttttaatgtatagagtagttgtttaaagtgtgtcggacgaataggtgttttatgtttagttatgtagataaaagtgtgttacgtggagggagttggtcgtggaagagattattagtattttggttgttcgaggattttgtttttgggtttttgtaggtatttttagtttattatttttttttttatttatagttatttattttttttttatttttttgatattagttttgttatttatttaggtttgtaagtaggaaattttagagttgattttgatttttgtttttttagtatttttaggttttaataggttgttaagattttattaattcgttttttgtatattgatttttggataggttgtttcggttacggttatgttttggttgggtttttattatttttttttggattagtaggtgttattttttttatttttgttttgttgtggtttttttttttttacggttaatatttagaggacgattattatttttttttttgtgtgttggggatcgggtgataggatttttttattcgattatttttattagatttgggtcgggtttttttatttatagagtttttagttttcgtttttaaagtttcgagggtggattcgtgttgtcgtttagtttggttttgatatcgttttttagtttggagttttttgtttttgcgtttttggttttgagtgttcgggttttttttggatgggttgttatttgttttttggaaagtagggtttttatgtttttggattttttagttgatttagtgattttgggttattttgttatattttttttattagtttggttttggttatttttgtgttttttatagtttcggattagagttacggcgggatgtttttttggtgcgtggtaggtagttaggaaatattgttggattgattttgataggagatgtttgggagaattgtttaaaaaattagtttaaaatgtaaatattggtttttttttgcgttggttaaagagtagtattttttcgtttgtttttcgggtaagaaattgatggcgaatgtaatgtttttagggaggagaagaaggtgataaaaagggtttgtataacggggtatacgttaggtatttgtgattatttaagtttaaattataatataaatgcgaaattttttgttttggtagtttttttatattgtaagcgtttattgttatatgtggttgttatattgattacggtagatatagaatattgatattattgcggagagttttatgggggggcgttggtttagattatttttacgttggatttataaatttattgtttatttagtgaacggttattgggtatttattgagtaagtaggatgaaagatattcgttttcgggggagtttttcgttggttgtagagaagtttaaatttaggggatttggggtaaattttgtaagggtttttggtttttgtatttttagatttttttcgttttgtaggggtagtcgggggttttttttaggaatggagcgttagttttagtttttgttaggttatagtttagatggttggttgagtacgagtatgtgagagtggaattgggtttaatcgggttgttttttttcgttgttttggtttttttttacgttgatttggaaggatttttaaagtaataggtttgtttaggcggtttgtattagtaaattttgtagcggttttaagggtagagatagttggattgtatttatttaggaatagttaaagtttgaggtataataaaaagtggagaaagattttagagaggaatgtagttggttttagtttgggaattcgttttgtttgggaggttgtaggcgggttaggttggggttagtttggagggttttggttggttttgttggtaggtatagtagtagggttagtaggagggagtttaggacggagtttttttatttttaatttagggaagtaaattttagtggttgagtttgaggatgagtaggaaatgaatggaaaagtttttttttttttttttttttttttaggtagggtttttttttgttttttaggttggagtgtagtggtataattatagtttattgtagttttaatttgttaggtttaagggatttttttgttttagttttttaagtagttgggattatagttgtgcgttattatgattggttaatttttaaaagaaatgtttttaggttaggtatggtgatttatgtttgtaattttagtatttttggagtcgaggtgggaggattatttgagtttaggtgttttagattagtttgggtaatatgacgagatttcgttttgattaaaaatataaaaagttagttgggcgtggtggtatagttttgtagttttagttattcgggaagttgaggttgtagtgagttgtgattacgttattgttttttagtttgggtaaagggagtaaggttttgttttaaaaaaaaaaattttttttttttttgaggtggagttttgttttgttgtttaggttggagtgtagtggtatgattttggtttattgtaatttttgttttttaggtttaagtgatttttttgttttagttttttaagtagttgggattataggtatgagttattgtgtttggattttttttttttttttttttttttgtagagatgggatttttttatgttgtttaggttggttttgaatttttggttttaagtgatttttttattttggttttttaaagtgttggaattataggtgtgagttattatatttagtaggaaaagttattttttaaagcgagaggttgtgcgttttttatagtttggcgtttattagtatggaggatttattggaacgtgtgttaggtgaggggatatggaagatggtagtaaattcgagtttagagtattagaaagtatgtttttagttaaagatgcgttttttttattttcgcgtagtatttttttttagtgtgtatttttggagtaaggtggggtcgattttacgaagattttttttcgaaggtttttgttgtttatattagtgttatttggatcgtttgtttttttttttggatggttggattagttttagggttttttggtttggtgtggggagtatagtttattttggggaatgtttggtatgtgttttttttttattgggtattaggggatgaagttgtgtttcgtggaaggggatagaggcgttggtgtttaggatggtgtatttggggcggttgaattggatttggtttttattgggtttttgtggagtttagattgttgtgagaaggggtggggaaaggtaggtgattcgtattttttatttttgttttatatgggaataggggtttattttgtatatatatttagtttggagtatgaatttttatgaagaggaaaatttttattaggttttgatgttaggattgttcgtgagggtcgggtcgtgttttggggtaaggataggagtggagggggtaattagggaaggttttttaatggaggaggtatttgatagtattttgaaaaagaagtagtttttaggttaagttagagattgaagaatgattatttaattttttttttttttttttgagatggaatttcgcgttgtcgtttaggttggagtgtagtggcgtgatttaggtttattgtaatttttattttttaggtttaagtaatttttttgttttagttttttgaatagttgggattataggtatgcgttattatgtttagttaatttttgtatttttagtagagacggggttttattatgttggttaggttggtttggaatttttgattttgtgatttatttgtttcggttttttaaagtgttgggattataggtatgagttattgtattcggttacgattatttaatttttttttataagatgttttttggttgacgtaaagtaggttgagtgagtgtgatattttttttttgtttgtgggtttcggtttttttagagttcggttagtgttattggagataaagtggttttcgtttttttttttcgttttgttaggtttagtttgtgtcgttgagttttattttgtaattaagaggagttgtgaattagtgatgttgatgtcgtagaaaagtggttaggggtttatggggggtgaaggatagggatgtcgttttgagaattgtttggaaggggtttttgggtaatagtgtttattttagggtgtgggtaggttggggtggttgggagttgggtttataggttggtataattagagttttttaaagtcgtgggtttgagggttttgtttttttgggatagtaatttttggtttaatttgggaaaaggtgggttaaattaagttcggtttttttattgtaggattatttagtgcgtttagtatgtaaatgtgtttttgaatttaagataggattatagaaatttttttagtgtttttttggagggagggatcgcgggggatttatcgtaggggtttgggtttgtattggtttggtgaagtgtttttttagtgtttatattatgcgcggtgagaggttggttttcgttttttttattttttgttggttttattttattatttttgtattcgttttttagtcggtttatgattaatttttgtttttttagagttaatcggtgttgttaggttttttattttaagtgatttttcgtttgggttaaaatgtttggatttttaggtacggaggggagatggattttaggttaaattatgttgggtaaaattgagggttaaggttgtgtttagtaagtgttttagttttggtcgttaaatttatagtgtgtatagcgtgtaggaggtggttgggtgaatgaatttagttatagttcggttttttattcggggttgtttttaagtttttatcgttagttaggttgggttagagtttcgtggggtttttttgggtttttttgttttatagtaggagttcgtatggagagtttcgagtgaggttaatgggtttttttttttttttttttttttttttttaatttgagatagggttttattttttttatttagttagggtgtagtagtgtaattatagtttatagtagtttcgaatttttggttttaagtaattttttcgtcgtagttttttaaagtgttgagattataggtacgtgttattttgtttagttggggtttttgttttttatttttttttttgtttttaaatttaatataaagaaagatattatatttataattagaaaaattaataaggaatattattttaaaattggaaaagggattaaagaaataaattaagaaatttttgcgatttttgtttatcggagttagtggttgttagtggttggtttaatataatgttttaggaagaaatagaataatagaaagtaattttagtgagttgagttttggtttcgtttgtggcgttgtattagttttttgtagttgttgtaacgagtggttataagttggttgggttataataacgtttagttatttttttatagttttgtaggttatatattcgagattagggttattaggttgaaattagggtgtttattgggtatagttttttggaggttttagggtaggggtttttagtttcgtgtgttttattaggaattggtttgtatagtaggaggtgagtgattggtaagcgagcgaagttttatttgtatttatagttattttttattgttcgtattattgtttaagttttgttttttgtttgattagttatggtattggatttttataggagagtgaatcgtattgtgaacggtatatgtgagggatttaggttgcgtgttttttatgagaatttgatgtttgatgatttgttatcgttttttattattattagatgggatcgtttggttgtaggaaaataagtttagggttttaattgattttatattatggtgagttgtataattattttattatatattataataataatagaaataaagtgtataattaatataacgtgtttgtggtcgggtgtagtggtttatatttgtaattttagagtgaaattttgttttaaaaaataaaaaataaaggttaggtatagtggtttatgtttgtaattttagtattttgggaggttaaggttggcggattacgaggttaggagtttaagattagtttggttaatatggtgaaatttcgtttttattaaaaatataaaaattagtcggatacggtggtaggcgtttgtagttttagttttttgggaggttgaggtagaagaattgtttgaatttaggtggcggaggttgtagtgaattgagatagtgttattgtattttagtttgggtggtagagcgagattttgttttaataaaataaaataaaataaaataataaatataatatatttgaattattttaaaattatttttttattttttggtttgtggaaaaattgttttttttgaaatcgattttaggtgttaaaaaggttgggggttattgtttttatcgtttgtttttttgagtttttggtggttgtgggtgttttttggtttgtggttgtatggtttttatttttaatattagtatttatagattttttcgggttttatttttatttggttatttttgtttgtgttaaatttttttttgttttcgttttgtatgagtatcgagattgtttttagggattatttagattatttagggtgttttcgttatagtaagatttgtaattgaattatagatgtaaaaatttttgttttaaataaggttttatttgtaggtttagggattaggatatgttatttttggggttattatttagttttttttcgtgattatgatttttttttttttttttagttttttatttcggttgagatgttgtttttattttttttattgtttggttgtttgtggggttgttttttaggttttttgggaggaggtggttgtttgatgttttttagaaggttgggaatggttttttttattttttaggaagatgttttttttgttaaggagattgtatttggggttttattttaggtagagagcggacgggattgtggtttgaagtggtattttagggtttttggttttgttatttagtcgagggttgtgtatgggttttatttggttataggtaatttatttggttttgtggggtagggattgtaaatttagaggtttgcggggtgtgtcgaggtagaggggtgtaaatattgtaaatttgttgggggttttggggagtagtatagattgaaaagtgttttgtttgaagagtagaattgttttatattagttttgtgcggttaggtaggaaggttttcgtggtgcggttacgcgtttttttttttttaatagaagttgatagtttggagtttttagagagattgtttgagtttttagttttggtataaatatatattttttttaaataggtttgggttaatagaattagttttcgtgtttcgggtttgaatgaatttttgaggtgaagtttaaagatagagaggatgtttttgatttttattttagggatttatattgtaaatttttatttgttttgttgagtttttggttttagtatggattttgattatgtgttggtggggattttttaggtaagtaagtagtttttgaggatttcggatgaatagtggggaatagtattgattttttagtggggtttcgagttttcggagaggaagattcgtttttttttaggggacggttagagatttattgatttatgcgtgtgtggtaggaattttttaggaagttttcgtttcgttcgttttttttgtttgggcggggacggtaattgtttttgttattgtagattaatgggacggaggggggtgattttttagggttttttttgggtaggtgtttcggaatttttttttagtacgttggtttggggtacggtcgttttttttgtttagttacgttggggtatagggtgaagaagggttggggttagtttaggatagaggaaggcgaggtaggtacgtaggaattgggttttttaaatttttaagtttaaggaaatcgtagtatcgcgggatagggaaaatgaaagattttggaagtcgttaggaatttgattttgtgagttggtttttaagagtttaagttaagtatttttaagtggatattaaaaaggagtagtaagtttcggggcggcgggggttggaggaggtggagagaggaggttgtcggaagtcgtattcgggatttttgtagttatcgattagatcgggcggtcgggattttgggattttcgtaggtagattcggtggtttgtcggatttttcggggtttatttcgggtttttttttttgttttttatttttggattttttttttttgtttttttttttttttcgttttgaagagataatgttattttagtttggagtataaatatatgattagtatatggaaatgtggtaattcggatgtattcgtgattgtaatagattgaagaaattagattagataaagagtgtttttagaggaggaggaggaggaggaggaggttgagagagggagggcgacgggggtgagaaaggggaggtcgtttttgagcgggacgtcgggattttcgtcgttgttaaatatattcgtaggaatggagagggatcggattttaggtacgtagatagttttttttttatcggtcgttttttattgttttggattcggggttttatttatgtttgggggaataagtatgtaaagggcgtttttgtttattttttatagaaatattttttttttttttgacggttttaagttcgtgggatgaatttcgttttagaagttaagtttttttgagtttggtttttatttaaattcggttttttttttttttggttattttttttttattttttagtgtgttatttttgtatgttatggttattgttaatgttgaggttgttggcgtcgaaattttgggagggtgtgggggatttgtttttttggttcgggtttggggcggcggcgtttggatttggttggtggttggtttgtttattgtgtggtttgttttttgtttttagttaaagtttgtttttaaggttgtttcggttttttatttaaaatagtatttttgtgtttttttggtagttgattatagagggggaagttttcggcgtttagaggagtttggcgtgtgtgtgtacgtgtgtgtgtatgtgtgtgcgtgtgtttatttacgttggtagtttttttgtcgtaggtatagatttattagggcgtgaataggtaaatgaagagaaagggggtttttttgtttttagtttattttagttttttaggtttttttttttaggtttagtttttttggtttttttatttatatgcggtgtcgtggttgttattttacgtggttagcgtcgttatcggtaattagtagtgatgatagtttttgtcgtttatgtcgttttttgagtttagcgttgggagatatggggtggttgagttaagttttaggttttgggtattttgaagtgatttacgggttatggagcgggaggtcgttaagagtgttaatttttacgtgttttgggttttggtttgttggttgttattatgtgtgtgttggggggtttttgagaggtttgagagagggaggtttatttcggtggtttttttttaggacgtgtggttttttttattattgtttttagggttatatttttttttttttttttttttgagacggagtttggttttgttgtttaggttggagtgtagtggcgcgattttagtttattgtaagtttcgtttttttagtttatgttatttttttgttttagttttttaagtagttgggattataggcgttcgttatatttttttgtatttttagtagagatggggttttatcgtgttaattaggatggtttcgattttttgatttcgtgattcgttcgttttagttttttaaagtgttgggattataggcgtgagttacggcgttcggttttagggttatattttgattgttacgttgggattggtggagcgggtgtgtgttgtgtcgttgagtatatttagtcgggtatagtaggcggattttaggagggggttaggggagacggtagaaggtttgggtggtagtgaaattgtattttatttgtttgagttcgggggtttaggttcgttgggacgggtgggtgtggagtttagcgttttgtttttcgtttagtaggagtcgtagggtagggagcgttgagagggattttcgttaggtttgtatagtggagtcgttttcggagtgattattttattaggtagtttgggtagattatagtgggttttttgttttttgggttattagttttaggaggacgttattttattcgtttggttggtaggggtttcggggagtttcgggttcggtttttattttatagatgatttagtcgaggtttagatgggtgattagtaggggatttgagagttgagtagagaggcgtgggtttgggggtggtgttttttggggagttggaagtgatggtatttttttaggtttataaaatacgggttttttatgaattgaataaaatattttttgaaagtagttagtgttgtgttttagagattattttgatttttgttgtttttggttgaggatagtatagttagggatgaagcggggattttttttcgggttgtgttttgatgaaagatgttttttataaaattttattcggatgtgtttttatgtaagaaaacgtatatttttagaaatttagttgtaaattggttgtttttcgaatgaatacgatagtttcggagttgttttttttaatgaggttttcgttttgggtaaattttagcgttggtttttaattgttattgaattttcgtatagtttttggggaagtgattttttttttgtttttgttgggtggttttgagtaagttatttggtagttttgggtcgtagtttcgttatttgtaaggtgaggggtgggagcggtacggtttttaggtagcgtttttattttttgcgggtttttgcgcgtgttttgagttttgtgggcgtttttttttttattgaggggttttttttttttgtagggtatggtttacgtcgcgttgttaggttgtaagttattgcgagagttgttttgatttttaagtatgttttggtttgaggaggagttatggggaggacgttgtgtttgtgtgatagaggtttgttcggtagatgtcggttcgttgatttttagacgtggttgtgggtgttttatgttttattgggttggcgtgtgaggcgtgtttagtttaggttgttttatagttgtttaggaagggtttgtgggagggggtggttttattttggtgagtttacggtggtttgttagttttagggaaggtttaggagttttaagatttgtttttttgtttttttttcggtagtgtttggtttcggtttggtttgtgaacgggggtttgggtattttttcgttttttttgggggttgtggtttttttttgggaaggtgttggagggtttgttagtagggtcggtatgagttatggagtggtgattggtcgttgaggtatggaaggttattttttttagttaagggtcggagttttttttttgttttggaacggttttgtggtttttataaattaagtagttttattttgttttaagagtttgtattttagtagggagagagtttttaagaagggaattttttattggggagttttgttgggttgggaggttaggaataggttacgagggagggttgtaggtaggggaagtggtcgtttgtgtatggttatgaatgtaggttcggggttttggagggggtttggttacgttgtcgttggacgtttgtttttattagggtttatttgatgtagtacggtatagggtaaagtttagttttttttacggggtttttgggttattagtgggcggggaatcgaggttttttggagggcggtgttttagtttttattttttttttttgtttttcgttgtgttgttttcgatggtttttgttattttttgggagtttttatttttggacgttcggtgtttgttcggttttaatttttttagttttgtttttttattttcgaggtgagaggtttggtttgacgcgttttgtattcgttttttgtttagtttcgtgggaattttggtttttgtagtggttttttggggttgttattattaagtgttataaattgggtggtttaaaatattagatattttttttttcgtcgttttggaggttagaagttcgaaattacggtattagtaggtttggtttttttcggaggtttcgagggggagtttgtttttcgtttttggtagtttttggcggttttcgaaatttttggcgttttttggttcgtggttatattattcgatttttgttttcgttgttacggggtttttttttgtgttttaaatttttttttgtttgttttttatacggatagtttttttcggatttagggtttattgggtaatttaaaatggttttattttaagatttttaattttataacgtttgtaaagattttttttttaaataggttatgtttataggttttggggtggatgtaaattttaggggttattttttatttttttgttgttttcgtgtgtttggatgtatagtatggttttatgttttagattttttgttggatttttttggttttttggggtggtttttggttttttttattcgtttttgtgtttttggtgaggtgtcggggtcgggtttagtttttgtaggaattttggggatagtatggagtcggtaattttttattaggcgtttttttatttgtttagagtttatggttgtgaggggtttttttttgtggttttgatttgtaattttttagtggttagtgatgttgagtattttttcgtgtttattgtttatttgtatatatttttgtagaaatgtttgtttaagttttttatttgtgtttgatttggatgattgttgttgttgagtgttaggagatttgtagattaatatttagatattaattttatatttgatttatgatttgttgttattttatggattgttttttttttacgttgttagtgttttttgatatgtaatttttttttttttttttgagatggagtttgattttgttgtttaggttggagtgtagtggtatgattttggtttattgtaattttcgtttttttggttttagcgatttttttgttttagttttttgagtagttgggattataggtattcgttattatatttagttaatttttgtatttttagtagagacggggttttattgtgttgattaagttggtttcgaatttttgattttaagtaatttattcgtttcggttttttaaagtgtcggagttataggcgtgagttatcgtatttaggttgatatgtaaatattttaaatttttatgacgttttattttatttatttgtttttttgttgtttgtgtttttggcgttatatttaagaaattattgttaaatgtaacgttaggaagttttttttttgtgtttttttttaagagttttgtggttttagtttttgagtttaggtttttgatgtaagttgagttgatttttgtatgtggtgtaagggttggtttagttttatgttttgggtttttgatttattttttttttttttttacgtttagttggtttcgttgggtggcggggaggagtggggaagtttcgggttgggtttgtattcgattatttttttttaggttagttagggagttttagtttttgtttaggatttggttggacgtgttttttatcgggaaagtttgggtcgtttttttaggttgatggtagggttagttcggggcgttttgaggtttgttttgcggatatgttttttgttttaggtggtgtggttgttcggtttgcgtgtgagattagttgtttgtgttttaggttatggaggttgagtgtttttagtttgtttttttgttcggttttttttttggggaagtttttgtagtttattttttgttttcgtttttgttatttgtgtttttgtttgttttttgtttggaggtggttatttttggggttattttttatgatttggatataagtttttattttgaagttattatttaaatttttgtgttttaaattttttttatttattatatgggtttttattgtgattaatttagtagttgatgaagttttttttggggtttttttagtaacggggagttggttttttcggaggtttggtttttttttaagtggaagtggggcgtgagggtgttagtttttttttgttgtttggtgttttaggttggtttgttatttttggaagtatttgttatttttatatagtattttatatttattttttcgttttttatttttttttttaaggggttatttttgtttttttttttatttaattttatttatgtggttcgtttagtaatttttgatttttaatatgataaaataaattttttttgtcggttatttatttatttatttagtattgggtgttttttgtggatttggcgttggggtttcgtggaggataaagttagatatagtttttgtttttatgggattgtataagtgtaagattatattagtaaacgtgaaatataggaagtgataggtgtgataaaggggattagtggtaggatagaatttgcggttcgtaggattaggttaggagggttgtttcggggggatattttcgggttgagcgtagaaggatgaggggagtaaattaggtttaaatttagtaggtagaggcgatcgttgtaggtaatcggtaatgtgtttaaaggttttggggcgcggggggttgaggtcggtagtacggtaggaagtaagattggggttgaaagagattgattgttatgttgtgaaatatatatttggtttttatttttattttttggtatataatttttaaaatttttggaatttttaaagtgatgtttttttggatgtttatgattgatagattagttggtagttttaggatggtttttagggaagattaggtagaattataaggtttagtattatttcgtaatttttaggtaggggagaggggttgaaggttaagtagattattagcggttaatgattgaattaattatgttttcgtaatgaggttttcgtgaatatttagaaggatggggtttcgggagtttttggatggatgagtatgtggaggtttttggagggtggagcgtttggggagtatatggaagttttgcgttttttttttatattttgttttatatatttttttttttgtattttttgtaatattttttataataaattagtaaattttatgagttttaggaatatgtgtaaaagaaaaaaaaaagaataaattatagttgttgtagtaagttaattttattagtattggtttttatttgtcgattttatttttggtaatgttttttttttttgggtttttgggattttttcggttttattattttttttgtagtggtttcgttggttgttgtttttaggttagtttatttttattcggtttgtttttattaggggttgaggtttttttgtttattttagttttttggttcgttttttgttttgggtatttttttatttcgaacggttagagtttttgaagtcgttcgttgtgtgttttcgtttggttttatgtatttcgtacggtgttttttagggttttttattggtaagggtattggtatagattttggggttgttttggtttaagtttattttgatttggagtttgagggtttttgagggggttttgaaggttagggtaggtaaggttggtatgttttgggtagtgggggttgggtatgggaggggatcgtgggtggggagattttttttaattagcggtttacgtttggagattgatttgggttttaggttacgttttgaaattgggatagagagtggcgtagattttagttcggagattttttttgtttgtggacgtttttatatttttattcgtggagttatttttttttttttttttttaaatggggaaattttgatttgaatattgaataaataatatattttcgaaattagcgaagaggtattggttttgaaattttgttatgaaagtttgaaaatgttttttggatcgatttgttggaatagacgggtgtgatggggttgcggggttttaggtggtaggaggcgttttcgtgtttagggtatttcgatgtttagagttttttcgtgtttagtgtgtttttgtatttagggtatttttatgtttagggtgttttcgtgtttagtgtgtttttgtatttagggtatttttatgtttagggttttttcgtgtttagggtgtttttgtatttagagtatttttatgtttagggtgttttcgtatttagggtgttttcgtttttagggcgttttgtgtttagggtgttttcgtgtttagtgtgtttttgtatttagggcgtttttatgtttagggtgtttttatgtttaggtattgtttttttttatttttttaatttttttttattaataggtgttagttgtgaaatgtttgttgtgtgtgttttttggttgagtttattttgtgtttttaagtttttgttagatataggtaggttgttttagtttttttggtaaatgttttgttgttgttgtttgatacggggttttatttcgttatttaggttggagtgtagtggcgttatttcgttttattgtaattttcgttttttaggtttaagcgatttttttgttttagttttttaaatagttgggatgataggcgttcgttattatgtttggttaatttttgtatttttagtagagatggggttttattatgttggttaggttggtttcgattttttgattttaagtgatttatttagtttggttttttaaagtgttgggattataggtatgagttatcgtgtttggttcgtttggtgaatgtttattgaggtttattatgtgtagttttttttttaggtgtttggtttgtaatgaggagtaataaagatatagtcgttggtcgtttgttatttaatagttggaattgagaggtagtttataaatgagtaaatttataggtggttttagatgaggattgtgaagaagttaagaataggttgttgggggtgtatatttgtgtgtgtggcgaggggattaatggaagttttttttgagtggtgatattgagttgaagttgtaatgattagaaggatttagttaggttaaaatttaagggaagagtaatttggtaaaggaaatagtaggtgtgaaggttcgaggttggagtttggggaaggtgggagtggttggagtgtgtttttagagacgggttatggtgatattaatgcgataggtagggttaggtcgtgtcgggttttggaggttttggtgagggtttgattttatttttattatggtgggattttagtgttttgtggttgttgagaatggttaggggtaggtagggaggtttgttagggaggaggttgttgtaggttttgtagttggagagggaggattaggatttttttagagaggaagttggagagggaggatttttttgattgttggatggatttatttgtttggttgttttcgttagtatttagtagaggttattggatgttgataggtggtcggttttgtttagttttgtattgttttgtgttgttttggtggttgtcggttttaggaggagcgtttttggtgtttgagtttagtggttttggttgtggtttggtatatttggtcgtgggtgaggttaaggtggtttggattttgggaaggttgggtatttggtagttttaaggtaggagttggggtgttggaggaggaagtacgtttatttttcgtttttttttgtttcgtgggatgttgagtttttgggtagggatatggtgagttttggtgtgatgtatttaatatttgttggtgtttttatttttaagtaggaattttggtgtttggtgtttgaggattgttgtttatcgttttattattttttaggtttttttttagtttttgattcggggtaaggtttagatatttagaatatttttggttggtttttggagttggggtgaggtagaattttttttttatatttatagtattagttaaggtttcggggtttggatattatttttgggaggggtgagtaggataagtgaggtttttagatttggggtggtttcggattggttaggtaggtgggtgggggttgtagtttatgttttcgttttaggtaatatagtcgagttgtagttttcgttttatttttagttggggttttttgtgtttattttttgttttttttttttttttcggaatggggggtggatattttaagattagttttttagttattttttttgttttttgttttttttttttcgggatagatttttgtgatcgttgggtgtttttgatgttttgttttttttgcgttttgtgtcgtgggtgagagagggtttcggggggattttttttttttggagtatttgttgtttcgggtgtttttgggggcgggtttttattttatattgtggagttggtgtaggaaggaaggtgtcgggagttagttttaatttacgtgttggttgtggtttttaaggtgtggatggtaggaggtggtgagatagggatttattgattatgggattgatatttttttatgttgatgtgggttttgagttataattttattagtttttgagttttggcgttgtttttggcgatggcgtggatttagttaggttttcgggtagttttttttggatttttttttcgtttttttttgggtagtgtttttgtttatttggaaaggatgggtaggatttggagataatagggatttaaagaagtcgggagtgggggtatttgtgtagtttattttgtagaatagataatttggttaaagtttaaagtttgttgttaggagtttcgtttgttttttagagagtatatggtttgattattacggggattgggggagaggtataggtatgtttgttcggtagtagaagggaatttcgggtttgggtttttttattttgtggcgttgtttttttttagagttgtattgttttttttattgtttttgtttggttttagtgtttatgtggtttgtggtttttagtttgggtttggtttttcgtaatttattttgtttagttttatatagtttgtttttttagttgggaatcggagtttatttggagttttaggtagtagattcgatgtagtgatgtagggttgttagttatgttagtaggttttgttgtttatagagggatgggtattgttgttgataataattaaagaattacggttttaggttgggtatagtggtttatatttgtaattttagaattttgggaggtcgaggtaggagaattaattgaatttaggagttttagattaggttgggtaatatagtaaggttttgtttttataaaaaataaaaaataataataataataaaaattatagttttagaatgattgattttagtatgtttataaagttaagggtttttagtgttttgggtttatgttattgcgttagagggagagaggaagaggttggggtgatgggtattggggtttatgttttttttggaatgggtggttttggattgtgtttgtgtgatatgtttgtcgagcgggggcggtgtttattgaggattggatgttgaggtgtgggtggggggaggttatgaagtattgggtatttttcgtgtattagtgtttcgagattgtagagaggggattcgtttagtttgggtagggaggcgggtggtagcgaggaaggggagaggaattcgggtgtagaaagttttttttttagtaggtggcgtcgtaagttttcgagagtttagtttttgcggggtttgtatttttattgaatttgtgggtagaggttgtttgggtgtagttttcgttaattgtgattgtttattgcgggcgaggggaagtggagtgtagagaatgtatcggagggtagatgattagttttcgtataggtacgggggtgttttttttttcgtataggtacggggggttcgagtttttggggtttttgttttaattgggcggggaaagggagggttggaagttgagttagggggaaagggggtggttttttgttattttttttattttattttttttatttttggttgataggttttaattttttttatatttttttaattttttgtcgtaaaattttttaaatatagaaaagatgaaagagggttgagtgtggtggtttatgattgtaattttagtattttgggaggttgaggtaggaggattatttgagtttaggagtttaagattagttcgggtaatatagtgagattttatttttataaaggatataaaaaattagttaggtatggtggtgtaggtttggagttttagttattcggaaggttgaggtgagaggattgtttgaatttgggaggttgaggttgtagtgagttgggattgtgttaatgtattttagtttgggcgatagaataaaattttgttttaaaaataaaataaaataaaattataaaaaagaaattatgaaagattttaaagtaaatatttatgtatttattatttagattttatagtaattattttgttgtttgttttattataaatttttttggttattagtatttacgttggttttgatgtatttaaaataagttgtagaaattagtatataatattttgttaatattttagtttgtattttattaattagagttcggtatttgtttgtgattatttttgtttttttttgaagtaaaatgtatatattttgagatgtataggtgtgaaacgtttcgttttttgaattttaataaaggtatttacgtgtattttagtttgattagaatatagaatattattattattttagtaagttttttatgtttttttaggtgtattatagtttttattttttttagggtaattataattgtgttttttttttattacgaaataattttgttagtttgagtgttttttagagttatttatgttgttgtaggtgttagcgatttgttttgttttattgttgagtaacgtttattgtgtgaatattttgtgggtttttagttatttttttgttgaaagatttttggttgtttttatttggaggtttttatgagtaaatttgttacgttggttttttttgtataagtttttttgtgtatatgggcgtttatttattttgtagaaatatttagagtaggtatagggtaggtatatatttagttttataagaaattgttagatttttttttaaagtggtttttttattttatatttttattagtaatggatacgagttttagttgttttatattttggttaatatttggtgttgttattttgtgaaattttagttattttggtgggcgtgtagtggtattattttattatggttttaatttgttttggtttgatgattaatgcggttgagtatatttttatgattggttttttatatattttttttttgtgaaatgtttttttaaatttgttgtttattttaaaattgggttgtttgatttttttttttggatattgattttttgttagatacgtgttttataaatattttattttagtttgtggtttgtttgtttattttttttttttttttaagaataaggtttcgttgtattgtttaagtaggtttgaaatttttgggtttaagttgtttttttgtttttgtttttttaagagtcggttttataggtatgagttattatgttcggtttgtttatttttttagtggtattttttaataagtaaaagtgtgttattttaatttttatgaagtttaatttaataaatttttttttttgtggttttttttttgtgttttttgtaagaaatttttgtttattttgttaaattgtaaagatatttatgtttttttttagaaggtttagagttatatagtttttatgaattaatttttgtatatggtgtgaggtagagggttagggtttattttgttgtcgttttatgtgtttatttagttgttttaaattttatttttttttaaagtttttattttgtatttttttggtgatttatgaggtcgtataattttttaagatttttgttggttatttacgtatttttttttgtaaaattatttgtttacgttttatttttttttaaaattatgttgttttaagatcgagtgatttttgaagtttttattttataatgtttgaaagaatgaatattttgttttttagttataggtttttgttttttgttttgtagttgtatagtggggtaagatttgggttttgttttgttgttgttttgttgtttttttatttgattgtttttttatgggttttatttaaaaaaaaaattggtcgggtatagtggtttacgtttgtaattttagtattttgggaggtcgaggcgggtagattacgaggttaggagattaagattattttggttaatacggtgaaattttatttttattaaaaatataaaaaattagtcgggcgtggtggcgggcgtttgtagttttagataatcgggaggtcgaggtaggaaaatggtgtgaatttgggaggcggagtttgtagtgagtcgagattgtattattgtattttagtttaggtgatagagtaagattttgttttaaaaaaaaaaaaaaaaaaaaatgttgttttatatgttttttatatattttggatataagttttttattagatatatgtattataagtttttttttttatattgtttttttttttttggtttttttaatgatgttatttaatgagtaagagtattttgtttttataaagtttaatttattaattttttttagtttcgatttatgatttttgtgatttatggaggaaatttttgtttatattaaggttaaaagaagtttttttattttttagaaattttatagttgtatattttatgattttttttattttttaattttttaaatttttatattttttaatttattatagtcgttaggatgttgtatgatttattttaaattagtttttgtatttggtttgaggttagggttaatttttgtttttttatatttatatttagttttagtatcgtttgttgaaaagatatattttattttattgaattatttgatatttttgttaaaaattattgattgtatatgtggttttatattagtatatgtacgtatatatatgtaggttttgtgttgattgtatgtgtggttttatattagtatatgtacgtatatatatattggttttatgttgattgtatatgtggttttgtattagtatatatatattagttttatattgattgtatatgtggttttgtattagtatatgtatatatatatatgtaggttttatgttgattgtatatgtggttttatattagtatatgtatatttatatatgtaggttttgtgttgattgtatatgtggttttgtattagtatatgtatatatatatatataggtttcgtgttgattgtatatgtggttttgtattagtatatgtatatatatatatgtaggttttatgttgattgtatatgtggttttgtattagtatatgtatatatatatatataggtttcgtgttgattgtatatgtggttttgtattagtatatgtatatatatatatgtaggttttatgttgattgtatatgtggttttgtattagtatatgtatatatatatatgtaggttttatgttgattgtatatgtagttttatattagtatatgtatatatatatatgtaggttttatgttgattgtatatgtagttttatattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatatatatgtggttttgtattagtatatgtatatatatatatgtaggtttcgtgttgattgtatatgtggttttgtattagtatatgtatatatatatatgtaggttttatgttgattgtatatgtggttttatattagtatatgtattgtatatatgtaggttttatgttgattgtatatgtggttttatattagtatatgtattgtatatatgtaggttttgtgttgagatattattgtgtttttttgatattttgtttatttttttgttgatgttatattttgattaatgtggttttatagtaagttttaatataaagttttttaaatatttaaaatattattttgaatattttaggttttttgagtttttttataaatttaagaagtagtttgttgatgtttataaaaatgtagtgtgaattttggttgagattgtgttgaatttgtagattaattaaggaagaattggtattttaataatattgagttttttgtatagatggtatattttcgttttaaaggtttttttgtattttttttatttttttattgaaaaaaaatttttatagaattatattgttttgtagtttttaagaaaaagattttgtatgttatttgttaaatttatttttaagaattttatttttggtattattttaagttgaaatagattttaaattttatttttaattatttgttgttagtatgtaaaaatataatagatttttgtatgtaaattttatattttatgattttttttaaagttatttattattttggtaatggttttgtaggttttttaggatttaaatatatagttttatttttttttgattttgatgttttgttttttttttttgttttattgtattggttagagttgttagtttagtattgaatagtagtgattagtggatatttttgtttgtgttaaatttataatgttaattttagatttgttatatatgatttttgttagattgaggaaatttttttttatttttaatttgttgaaattttttaatatgaatgggtatgattttagtaaatgttttttttgtatttatggaaatgattattgttttgttttttattcgtttaataggataaattataatgattgatttttgtttttcgttttttttttttttttttttaaagaaatagagttttatttttgtttaggttgtagtatagtggtgttatcgtagtttattgtagtttgaatttttggatttaagtaatttttttattttagttttttaagtagtagggattataggtatatgttattatgttaagttaatttttaatttttaaaattttttgtatagatggggttttattgtgttgtttaggttggtttgtaatttttgagtttaagtaatatttttatttttgttttttaaagtgttgagattataggtgtgagttattgtgtaggtttgattttttaatattgaattaattttgtatttttggaagaagtttaatttgtttatgagatattattttttttatatattgttaaatttgatttgtttagtttttaaggatttttgcgtgttgatttatgagggatattggtgtggtattttttttgtttgttagtttgtttcggtaatgtttttgttagttttattttggttttataaaattagtttggaagtgtttttttttttttgttttttgtgtttttataaggttgatgttgttttttttttaaatgtttgatagaatttattaagaaaatcgtttggatttagaattttttattaggaaaggtgattgtttgtttttaattataaatttaatttaatgtatagaaagagttatttaggtttttttatttttttttgttttatttttggtaagttgtattttgaaggaatttgttttttttaggtaagttgttgaatttatttatttaaagttgttcgtaatataagtatatttagggtttgtttttagatttcggtaataaagtaaatattgtaataaagtacgttatataaattttttggttttttagtatatataaaagttatgtttaggttaggtatggtggtttatgtttgtaattttagttttttgggaggttaaggtgggcggattatttgaggttaggagtttgagaatagtttggttaatatggtgaaattttatttttattagaaatataaaaattagttgggtgtggtggtatatgtttgtagttttagttgtttgggaggttgaggtgggagaattgttcgaatttgggaggtggaggttgcggtgagttgagattatattattgtattttagattgggtgatagggcgagattttattttaaaaaaaaaagaaaaaagttatgtttatattatattatagtttattaaagtgtataagattattatgtttttttgttaaaaaatgttaataattatttgagtttttagtaagttataattttttttttggtagaaggtttgttttaatgttgatggttgttgattaggtggtggttgttgaaagttgaaggtagttgtggtagtagtttttttgttttttttttttttttttttttttttgagatagagttttgttttattgtttaggttggagtgtagtggtacgattttagtttattgtaatttttgtttttcgggtttaagtaatttttttgttttagtttttcgagtagttgggattataggtgtttgttattacgtttggttaatttttgtatttttagtagagatagggttttattttgttggttaggttggttttaaatttttgattttaggtgatttatttgttttggttttttaaagtgttgggattataggcgtgagttattgtatttggtcggtagttttttaattgaagtttttgatatgggttgatttttttttttatgaaagatttttttgtggtacgtattatgtttgatagtattttatttataatagagttttttttaaaattagagttaatttttttaattttggttacggattgattaaataagttgatgtaatattttaaattttttgttgttattttaataatgtttatagtattttcgtttggagtagattttatttttaggaattattttgtttgtttatttataagaagtaattttttatttgtttaagtttgattatgggattgtagtaatttagttttatttttaggttttatttttaattttagttttttgttatttttattatatttgtagtgattttttttgttgaagttttaaatcgtttatttatgagggttggaattaattttttttaaatttttgttaatgttgatattttaatttttttttgtgaattataagtgtttttaatggtatttagaatggggaattttttttagaaggtttttaatttattttgtttagatttattagaggaattattaattatggtagatattgttttataaaatatattttttaaataataagatttgaaaattaaatttattttttttttatgggttgtagaatgggtgttatattagtaggtatgaaaataatatttatttttatatatattttcgttagagtttttgggttataaggtgtattgttaatgagtaataatattttgaaaggattttttttttttgagtagtaggttttaatgatttttttttttttttgatggagtttcgttgtgttatttagaatggaatgcggtggtatgatttcggtttattgtaatttttgtttttcgggtttaagtgatttttgtgttttagttttttgagtagttgggattataggtatatattattatgtttggttagtttttgtattttttgtagaaatagggttttattatgttggttaggttggtttcgaatttttgattttaggtgatttatttgttttagttttttaaagtattgggattataggtatgagttattgtatcgggttttatttgttttttttttgttgttgttttttaattgagatagagtttcgttttgttgtttagattggagtgtagtagcgttattttagtttatcgtagttttcgttttttaggtttaagtgatttttttgttttagttttttgagtagttgggattgtaggtgtgtattattatgtttggttaatttttgtatttttaatagagatgaggttttattattatgttggttaggttggttttgaatttttgaatttaggtgatttgtttgttttggttttttaaaatgttgggattatagttgtgagttatcgtgtttggtttttttttgtttttttgtttttttttaaattgagatagagtttttttttgttgtttaggttggagtatagtggtacgatttcggtttattgtaattttcgttttttgggtttaagcggtttttttgttttagttttttaagtagttggaattataggcgtgtgatattatgtttgaataatttttgtatttttagtagagatgcggttttattatgttggttaggttggtttcgaatttttgattttaagtgattttttcgttttagtttttaaaagtgttgggattataggcgtgagttgtcgtattaggttttaatgggtttttaatatttagtaaattatgttgtaaatagatgtgttgttaagtagggtttgttattttatttttgaagtatagatagaatagatttggtagaatttttaagggttttaggatttttggaacggttaatgagtattggttttaatttacggttaatagttgcgttagttttttatgagagttagtttgttttttgaagttttaaagataggtattgattttttttttttagttatgaaaattttagatgatatttttttttagtagaaggtgggatatttatgttgaaattttgttgtttagtgtagttatttttattagtgttttgagttagattttttgggtaatttgttgtcgtttttttattagtatttgttgttttattttgtatttttatattatagagatggtttttttttttaaattttatgatttgatttttgttagttttaaattttttttttttagtttttttattttttttagtttttatattattgaagagagttagggttttgttttggattaggtttttgtttaagggaatgttgtggttgatttgattttttatttagattatttaaattttttttatattagtattaaggttgttttgttttttttttttttatgtgtgtattggaatcgtatttttaattttttttaataatttttttttggtatttataatttggttagttatttggtataagagattttatttttgtttgttttggttttcgatacgttttttttatttagtttaattatttttagtttttgatttaaagtgagagacgggtgatttttttttttatttgaatatttagaggttattgtagggttattaattggtttaattttaatattgttgagttttagggaatagggatgtttgagtagagggagagagagcggggaatagttagttagtggagtagttagaatatataacgtttattgaataagtttattgttttatttggatgtggttcgttatgttttaaaaataattgtaataatggtattgaagattattgattattgggcgcggtggtttatgtttgtaattttagtattttgggaggtcgaggtaggtggattatttgaggttaggagtttgagattagtttggttaatatggtgaaatttcgtttttattaaaaatattaaaattagttaggcgtggtggcgggtgtttgtagttttagttattggggaagttggggtagaagagtcgtttgaatttgggaggtggaggttgtagtgagtcgagattatattattgtattttattgtattttagtttgggtaatagagcgagattttattttaaaaaaaaaaaaaaagggtcgggcgtagtggtttacgtttgtaattttagtattttgggaggtcgaggcgggtagattatgaggttaggggattgagattattttggttaatacgatgaaatttcgtttttattaaagatacgaaaaaaatagtcgggcgtggtggtgggtgtttgtagttttagttattcgggaggttgaggtaggagaatggcgtgaattcgggaggcggagtttgtagtgagtcgagatcgcgtcgttgtattttagatagagtaagattttgttttaaaaaaaaaaaaataaagaaagaaaaaagaaaaaagagattatagattattatagtagatataataataatgaaaaagtttgaattattttaagaattattaaatttttatatagagatatagtgttaatatgttgttggaaaaatggtgttagtagatttatttgatgtagggttgttacgaatttttaatttgtaaaaagtgtagtatttgtgaagtataatgaaatgaggtgtgtttgtgttttttgttattgtaatgtcggtaggattcgtaaggaaaatattttattttttttattgtgattttatgttcgttattttttttttattagtagtttggttaggaggttattaatttagatttttttaaagaattagtattggattttttttttttggtgtttatttttttgagtttttttgttatttttattatttttttttttgtatttgttttagcgtattagttagggtttagttaggaaataaaaattatatcggtaatttgaatagtaatttgtaatataaagtgtttttaattgtaagaggtagttaattattaaagggattataaaggggtgatattgtgatataagaaagatgtatttgggttgggttcggtgtagtggtttatgtttgtaattttagtattttgggaggttgaggtaggcggattttttgagtttaggagtttgagattagtttgggtaatatggtgaaattttatgtttattaaaaatataaaaaattattttggcgtggcggtgtgtgtttgcggttttagttatttgggaggttgaggtgagaggatagtttgagttcgggaaggtagacgttgtggtgagtcgagattgtattattgtattttagtttggatgatagagggagattttgttttaaaaattaatgtatttgtttgtttgtttgtttatttatttatttatttatttatttatttatttatttagtttttgttttttaattttgtttggtatgtagtttttaaaatttttgaaatttttaaagtgatgggtgtttttttgtttgttaaggaggcgattggtggttggaggtttttggatagtttggggataagggttggttgttaggggatttagttttgtgattagaaggttagaatttgtagttttttttatttattttttgcgaggtaagaggggatgaaggttgagttgattattaatggttaaagattttatgttatgtttatgtagtgaagtttttttgaaaatttaaaaggatgaggtttgtagagttttaggttgttgaatatttgtaggtgttgggagggtagtgtattttttcgtggaagttttatgtcgttttttttatattttttttatgtattttttttagttggttgtttatttgtattttttgaaatattatttgtaataagttagtaattttaagtaaattgattttttgggttttgtgagttatttaagtaaattattgaatttgagaagggagttgtgaagattttaaatttgtagttaagttagatagaagttatgggtaatttggtgttttattatttgcgattgatttttgaagttgagggtagttttgtgagatggaatttttaatttatgggatttgtattaattttggttggtgttagaattgaattgaattgtaggatatttagttggggattgttgagtattggagaattgtttgggggtcggcgggaggaaattatatatttggtgttagagttgaagtattgagtgttgtgaatgagagtggagagatagagtttgttttgttttatgtaagaggattttaaggagtatagaaagagtaaatatgagaagtagttattttagaagaaaatataggaggaaagtttcgtgatattggagttggtaatgtttttttggatgtgatatcgaaaatataataaaagaaataaatgataaattggattttattaaaatttaaaatttttgtgtattaaggaatattattaatggcgtgaaaaggaaatttatagaatggaagaaagtatttgaaaatcgtatattcgataaaggattagtatttagaatatataaagaatttttataattaagttataaaataaaaaaaaataatttagtgaatagatatttttttatagaagatatattaatggttaagaagtataggaagagatgcgtagtgttattaattattagggaaatgaaaattaaagttataataaaatatgattttatattttttaaggtggttgttagttaaaatatggataatagtaagtgttggtaaggatatggagaaattggagtttcgtgtattgttggtgggaatgtaaaatggtgtagttgttgtggaaaagatataataattgtttaaaaaattaaatttagaatgattataatatttagtgattttatttttagatgtatattttaaagaattgatagtagggatttgaataggtgtgttatatttttgtttgtagtagtattttttttataattaaaagatgtaggtaatttaggtgtttattagcggatgaatgaatagataaaatgtggtttatttgtatagtggaatattattttgttttaaaaaggaaggagaggttaggtgtggtggtttacgtttgtaattttagcgttttggaaggtcgaggtgggtagattatttgaggttaggagtttgagattagtttggttagtatggcgaaattttgtttttgttaaaaatataaaaattagttaggtatgggggtatgtgtttgtaattttagttattagggaggttgaggtaggagaatcgtttgaattagggaggtggaggttgtagtgagtcgagattatgttattgtattttagtttgggcgatagagtaagattgttttaaaaaaaaaaaaaaaaaaaaaaaaaaaggagattttgatatatgttatagtatagatgagttttgaagatatgttaagtgatagaagttagatatgaaaagataaatattgtatgattttatttttatgaggtttttagagtagttaaatttagagagatagaaagtgggatggaggttgttagaggttgggggaagggagaatgaatgggaagttggtgtttaatggggatagaattgtagtttgggaagatgagatggatggtggtgatggttatataatagtgtgaatgtgttttatgttattaaattgtatatttgaaaatggttaaaatggtaaattttttgtgatggatattttaaggtatgtatgtaaatatatagaagtagttattattattggggttgatggaaaagaaattaagaattcggagcgttttttatattttgttacgttttacgtttaggttttgttggagagtgtgtgattgttatagaaatttgtagtttattggtaataaaaaggtttttgttagaaggtgtagaaagagtggatttgtaggattagtttattgggtagtcgagaaatttattagagggtatgggtgggtaggagttgggtgtttgagaagtttgttgaggttttattgggttagagttggggtgttggagaaatttagtatagagtaggttttattgggtatacgttattggtagttgtgtttttagaggaaaaagagattttggaattaggaagagaagttgttattttagtaaggtttggtagttttttatagtgttgttttttgtggatagagtttgatatgattgtatttggttaaggagaaagatttataaggtttcggtttagtattacggagcggggtttggtaggatgtatgtagagttaagaggtaatatatgggtaattggtatatttttttagattttttgttttttttgttgttttgttttgttttgttttgttttgttttgttttgagagagtattttgttttgttgtttaggttggagtgtagtggtatgatttaggtttattgtaatttttatttttcgggtttaagttatttttttgttttagttttttaagtagttggagatgtttattatgtttagttaatttttgtatttttagtagagatagggttttattatgttggttaggttggttttgaatttttgattttaggtgatttatttgttttggttttttaaagtgttgggattataggcgtgagttatattgtatttggtttatttttttagatttttaaagtagatttttaggtttttttttttttttttttttttttttttttattttttttttaatataagtatttatagtttttttttaagtattagttttagtttacgtattttagtatgttgtgtttttattattattttatttgaaatattgtaaaattttttttgtgattttttttttgatttatgggttatttagaagtatgttgtttaatttgtaaatagttaaggtttttttgagtattttagagttattgatttttaatttaattttattttggttagataagtatattttgtatgtttttaaaatttgagatttatggtttagaatgtgtattttggtgaatgtattgtttttatttgagaaaaaaatatgtatatatattttagattttttgagtatagagttttataattgttgattaggttaattgttagttattagtgttttttagattatttgatgtttgttttttagatgttgagagaatggtgtttgttatggtttatttgtttgtgttttttaaaatttatatgttggagtttaatttttggtgtagtggtgttgggaattggggtattagggaagtattggtttatgagggtagagttatcgtgaatgggattagttttttttgttatgtggggatatagtaggaaaaggatatttttgaagtagggagttagtttttattagatattgagtattttgattttggattttttagtttttagaattgtgagtattataatttgtttataaattatttagtttaaggtattttgttttaatattttgaatgaattgaggtggtgttaaaatttttaattatgtatttaggcgtagtggtttatatttgtaattttagtattttaggaggttaaggcgggtggattatttgaggttaggagtttgagattagtttggataatatggtgaaattttgtttttattaaaaatataaaaattagttgggcgtggtggtaggtttttgtaattttagttattcgggaggttgaggtaggagaatcgtttgaatttaggaggtggaggttgtagtgagtcgagattgtattattgtattttagtttgggtaataagagtgaaatttcgttttaaaaaaaaaaaaaaagagtttttatttatgattgtggaattgtttatttttttttttaatttttttaggttttatattatgtattttgaagtttttttggttaggtgtatatatatttatgattataatggtgtttcgatgaattgattatttaattatgatgaatgtatttttttatttcgtaataattttattttggatttaattttattgatatttatgtagtttttttagtttttttaaatatgttgtttgggatgtataagaaggttggagaggtttatggagaaatttatgatggtttgatttatagttttttaattttattatggtgcgaacgtggtatgtatatagtagaaattgtattttaagtatgtgtgaaattattgtgttttttatttttagtatagtatttaataatttatatgagatagttaatattttattataaaataggttttgtgtttgttgattttgtttaattgtaggttgaagtaagtgttttaattatgttaaggtaggttaggttaagttagaatgttcggtaagttagatgtattaagtgtatttttgagatgatatttattttttatttatgatgggtttgttaagatataattttattattatttaagtagtattagtatgtttttttttaaatagaaaattttaatttgtgtttatattgaaatagtattttttgtagatagtatatagttgagttttgttattttatttattttgatagttttcgttttttaattggaatatttaggttatttttgtttaatatagttatagatatgattgggtttagagttattattttgttttttgatatttattttttttattttgtttttttggttttttttatgttaattaagtattttttagaattttattttaatttatgttttttttttttttttttttttaagatagagttttattttgttgtttaggttggagtgtaatagtatgattttggtttattgtaatttttgttttttgggtttaagtgatttttttgttttagtttttttagtatattgggattatagacgtttgttattacggtcggttaatttttgtatttttagtaaagacggggttttattatgttggttaggttggtttcgaatttttgattttaggcgattcgtttattttggttttttaaagtgttgggattataagcgtgagttattgagttcggtttgttttgattttttaattgtatttttttgtattgttattttagtagttattttatagattttattgtatatttttagttttttatagtttatttagaattaatattgtttttttttatggaaaaaaagtgtaagaattaggtaattttatgggtttatttattattttttattttgtatgtgatggttgttagatatttattatatttatatatattgtaaattagataatataataaggaaatttttgttttaaatagttttatgtattttaaagaaattaaaagtaaaatagaattttttttatttgtttatgtatttgttatattttgtgttttttatttttttttgaagagttgagtttttatttggttttattttttatgattttggagaatttgttttacggtttttgtagtgtaggtttgtagatagttaatttttttttatttttatttatttgtaaatttttattttgttgttattttttttttttttatttttatttttatttttgagatagagttttattttgtttttttataggttatagtgtaatggtgtgattttaaaatttttgtttaattttaatttattaatttttttttttcgggtttaaacgatttttttgttttagttttttaagtagttgggattataggtatgtgttattatatttagttaatttttgtatttttagtagagatgggattttattatgatggttaggttggtttcgaatttttgattttaagtgatttgtttgttttggttttttaaaatgttgggattataggtgtgagttattgtgtttagtttgttgttatttttgaattataattttattggttatagaattttgagttgttagtttttttttttaggattttaaaatatagggttttagtgtttttggttttcgttgtttttgttaaggaattagtatttatttagttatttttttgtagattatatgttgtttttttttggatgtttttaagattttttatttaagtttgattgtttagtatttatttttgggtaaaaaagtttttagaaattagaaatttatttagttttatttttttttgttaggtgtagattttattttagtttttatttatttgagatattttatattgattttaggttgttgttattttgtttttttaaatattttgtttagagttataatgttttttgtagaattgattagatagtagttattttttgtgattaggagttttgattttttagatttgttgatgggtttataaagtttttgttcgtggtttttagttggtagtggtttttttgttttgaagttgttatgagtgtgtaaaatttataggtttaattttttttattagtatagtttagaaaagtggaatttttggtttgggtggttatggtgttttagattattggttagattagggtggtgattgttagttggtcgaatgtggggtttttagtttagtatttttggattttattttaggagttatggttgttttagggttaggggtttggttttagtttttgtttttttttttttttttttaagttgtttagtattaggttttaattagtattttttgtagatagggtgggtcggttttttattagaggggtagggttgggcgggaagtttgttgagtttttttttttgtgtagtttatagttttggggttagttttagaggggtgtagaaaggagtttttaaaggtagaaatttatttttttttttgtttttgtgtttttagggataaaggagaggtggttttagttggggggttattagtggtatgtaggaggtttatatgattattgtttgttggggtttttttttttttgtgagagagacgagagagaggagagagagtgtgagttagggtagtgtttttttttagtaacgtagatttttgtacgtgttttttaggagaaatttcgttattcgttagagttttagatttggaagaagttttgtttttttttttttttttagtgtagtgtgtgtgtgtgtgtgtgtgtgtgtgtttttatatgtattatatttttttatagaggaaataattttcgtttaagtgtaaaggttgggattggagtaggtagtatgtgggttaaaggagtagagaggaggaaacgggggcgggggtgagggtgggaataggaggtgggtagatgttacgaggtatgttttttataattagaagggttggtggagatgattagaatgttttagatagattttttattaaatttttaaaatttaattttgttttatgaagtttgaggattttgtagagtgaaagataaggaagggtttttttgtaggggggtgtgtgtgtttgtgtgtgtttgtgtgttgtgtgtttttatgtgtgtgtacgtgtggatttgtgtggtgtgtgtttgtatatgtgtgtacgtgtggatttgtgtggtgtgtgttgagtgtgtatatgtgtgtgtttgtgtgttgtgtatgtatttgtatatgtgtatatagattttattttttttttttttggtttattaagtgttagaaagaattttcgtgagtttttttattttttttaaggttgtatatggagggatttgcgtaggtatatgtgcgcgtgtatataatatatatatatatatatatatatatatatatatatatatacgagttaggggcgagtatttttgtggattgtatttaggtttggtaggaaatcgggttttgggaaattgtaggttttatttttggtagaaaattatgtttttgttgttgttcgttgaagggaatattaagtggggttggggatagtttatgttgagaagagtaaattttgtttatggtattggggatattgagtggtttttgtttcgggttttggagggtttgggagatacgtttgtagttttgggtattttttaaggttacgggcggttatatttaaggttaggtttttttttgtgtgagttgcggttagtaggaaggttgattttagaggcggttttagggtttttggaggttttgtttttgagatatgggttaaggttagagagtcgagaaggttgttgttgaggattttggttggcgtttagtttagcggttttttaggcgggttttgtgtaggggttgatgaagttagttgggaaatttgtgaaataaagtataggttttttaggtttgtttagagtttcggtattagatgaggtgtagagaagggaattgagttgttaagtgtgaataggagagaggagttttaggattatataggggtttcgatatggtaggtgtttggttagtagcggtgttgtttttattgttggacgtgggaaaatgtattgatatttgttgattagagtcggggtgagtatttgggtgattttgtagatgagataaaataagggttgtcgtgggggaggggtttttgtcgggttattttgttgaggttttgtgttattgttttgcggttgttataataaaggattataaatgaggtgatttaaaatattcgaaatcggttacgtgcggtggtttatgtttgtaattttagtattttgggaggtcgaggcggttggattacgaggttaggagatcgagattattttggttaatatggtgaaatttcgtttttattaaaaatataaaaaaaaaaaaaaaattagtcgggcgtggtggtgggtgtttgtagttttagttgtttaggaggttgaggtaggagaatggtatgaattttggaggtggaggttgtagtgagtcgagatcgcgttattgtattttagtttgggtgatagagtaagatttcgttttaaaaataaaaataaaaataaaaataaaaatattcgaaatgttttttttaaagtttttggagttagaaattttagatcgaggtgtttgaaggtttattttttttgggggtttcgagggagattgttttatgttttttttcgagttttgcggcggttagtaatttttggtatttttcggtttgtagttcggtttattttttatttggtttttattttgtgtttttttttgtgtttttgtttaaattgttttttttgttgtttttttaatttatttttagggataggtttttattttgttttttaggttggagtgtagtggcgtgattatggtttattgtagttttagttttttaggtttaagtaatttttttattttagttttttaagtagttgggatataggcgtacgttattatgtttggttaattttttaatttttttgtagagacgagggtttaggttggttttaaatttttgcgtttaggtaatgagattttgttttttaaaatattgggattagagatatgagttgttgtgtttagtttatttttgttttataaagatatttgttattggatttagggtttattttgatttaatatgtttttaaataatttaattatatttttaaagattttatgtttatataaagttatatttataggtattggggggttaggatttgtatatgttttttgggggaatataatttaatttataatgggttttatttatagaacgaacggtttttttagggtgtgcgtaggtgggtgaggggtttaggagagggatttgcgtggtaagagggtttgtgtttacgttagagattttagaaggagattggatggggtggttgtatggagtaaggggttatagttattgtttttaagtagttggtgggttgtttggtagaaagggagtatttattttgagtttttttaagatatgaagttagtattaggtatttggaaggtgttagcgagtagagtttgattttttatagaaagaggtgttttttttataatgtttatttgaggacggtggaataggttattttataaggtagtgagttttttatgtttggaagtatttaagtaggggttatgtgggagttgtttaggagtgtatagaagggattttagaggtttttgttaatattatttttgtttgttttattttacgataatttgaattttagaatgtaatgttattggggatatgtttattagaggggtttttagtattaggttttatatattatgtattatttttagggtagggaatgagagtaggttttattttttttggttgtttgtgaggattaggaggtttgttgttgaggtagttttttgtggaaatagtgttttagtttcgtaatttatttatcggagttttaatattttaatgaaatattgtgttagatgggttttgggtatgtgtgtgtagattgttataagtttatgagaatgtatatacgtatattgtatgtgtgtgtatatatgtatgtatatatgtataagaatacgaagattcgaggtaggtatagttcgtgagatagatttttttaggttgaaagattttttataagggtttttagaataaggttttagtttcggtagttttttttatttttggtgggaggatttttatagagaagaagggttaagaagtatagtttttgatgtttacggtgtattaagttttgttttaagtttgtgttttattttttatttatttagtaaatttgtcgtttttgttttgtgttagatgttgtttttagtattttataaatattgatgtatgtttgttttatgataattttgtgaagtaggtagtgttatttcgttttatagatgaggaaataggcgtagagggataaagggatttgtttaaggtttgtttttattttatacgtatatgaacgtttatttatgcggtaggcgttagtttttttttgatgtgagttaggttttgagttggttggggtttgggttttattttggttgtgttttgttgtgggtattaaggaagtttttagtagttttatttttttggtatgatttagttttagggattggatttttttaaatgtttttgtttagtttggagttttttttttagttgggggagggttgaacgattttttatttttggaggttgtcggagttttttttgtttgtatgcggtcgttgtcgggtggataggtttgtttgtgggttgaggtttttagtagttggggtggattatttttttttttaagaagttttgggagaagtagttgagggggttagcgtttttttgaggttaattttttgttttttttagcgtaggcgcgaagttatttttgtttgtgtgtttgttatagatagtggagggcggtgtaatcgtgacgtttgtttgttgtattttgcgtttttgaggacgttgatttttggtcggtgttgggcgtttgttttttagttattttgttttgatttggcgtggtaggttcgagtattgtttttttataaggaaataggtttagaggttttgagttatttgttcgggtttttttagttaataattggttgagttaggatttttatttagttttgtgattttagaagtttaagttttttttattacgttagggttaggaaaggattagaatgtttttttacgtgtcgattatttggatgatttgtgtagtttagttcgttgtagttgtttaataaaaatgtggaatgaatgggtttatatgttttattgtgtgatttagagttaatgattttggttgatttttttgtttttatttcgtggtttagtatttttttttggggtgtgtgattttggaagtagtgattttttttattttattttgaatggtgtttgcgtcgtagtaggggagtagttggggattgttagcgtttgttgttggtgggttgtgcgttagatttcgttttggatgtgtgggtgattgttagttatatgtgtgtgaagggttgtgcgtgtaggatttgtgtaaatgtgtttttttttgttgttagtttatgggaggttgttaagattttgtttttgtatattagtttatattttttttgtggtttattgttgtggttgtttttttgtgttacgtggttgtaggtatagtttttaagtggatggggatcgtgggttgaatgtgtattagatgtttttgttttttggtgggtggagatttttaatttatgtatcgtggttgtcgtatttgaaaggttttttatggtgaaggatttggatttgagtaatttttcgtagaggttttagaagtgttttttggtcgggcgcggtggtttatatttgtaattttagtattttgggaggtcgaggtgggcggattataaggttaggagatcgagattattttggttaatacggtgaaatttcgtttttattaaaaatataaaaaattagtcgggcgtggtggcgggtgtttgtagttttagttattcgggaggttgaggtaggagaatggcgtgaatttaggaggcggagtttgtagtgagtcgagatcgcgttattgtattttagtttgggcgatagagcgagatttcgttttaaaaaaaaaaaaaaaatgaagtgtttttagtttttttttttgtggtgaggttttgagtttttatttttagaagaaaatttggttggggagggtatttttagattcggatataaacgttaggagattagggttgtttttttaggtgattaattatagagatttagggaaagttacgtttggaagaggcgatattgtgttttagttttatttatttttttattttatagatattgtttggtgtttagttcgtatcgcgaggttttttaagtagttttgggtatcgtgtatttggtatggtttttagttttatttttttgttttgggagattcggtggggatttcgggttgagtttttgtggttgtggaattttggtggtttattgtggtggttgagaatagggacgtggggttggacgggttgagtgtaatttttagtggtttcgtgaattgtttgggagttttgggtagtttttttttattttgtgttttcgttttttgatggaaaaatgggggttaggggggagcgattttgaaggtattcgtgggaattaagcgaggtgataaatgtagtgtttttggtagagaattggatatagagtttatttttatgaagggggttgttttttttttttttatgtttttttttgtttttatttttttttttgtattttttttttttgtttttttttttttttttttttttttttatatgtaggtatattttatttggtgttttaattgtttttttttattgtttttttgtaagtggttttttaagtgggaatttaggtttggaaagggtgggtattttgtttggtgggttttggtaggttaggcgttgagtagttttaggagatataattttaggaaaaggtttatgtaggttggttgttatgacggattgttggtgggagaggggaaggcgtcgtggtaggggaagttttggaaatatttattagtggttttatttatgatttaggatatttgttaggttattagaatatagttgaggaagttgtcggttagacgtttagaagtattaatttggtggttgggttgtggggggatttttttggataggtagataaggtgtcggaggaaggggttgatatttatttagtgtttgttatgtattgagggtataaagggtaggatggagagttggtttacgttatttgtggaattttttaggtgtgggggtagatggggaagtaagggggtttgaagatatatgcgtttattaaatgtttttaaattttaagaagaagaataaggatatatttataggggtagggttgaaagtttgatgtatggtgttttggggtttgtttttgttgtaatagttatagtggtttttttttattttttttttttttttattttgttgtgaaaatgtttaaaatatatggttaagttgaaagtattttatagggaatatatttagttattatttagattttattattaatattaagttatatttgttttattattttatcgtttatttatttttttttcgtttggttatgaatttattttatttttattttttggtgtattttaaagtaattttaggttattttgattatttttggaattattgttagaaatttttttttttttttttttttttttttttttttttttttttgagatgggattttgttaggttatttaggttgaagtgcggtggtgtagttatagtatattgtagtttttaattttcgagtttaagtaatttttttgttttagttttttgagtagttgggatcgtaggtatttattattatatttagttttatttttaaaattttttattaattttttattttttgtatttatttaggattattttttataaagttagggtgttgtaggaggggttagaattttaagttttaattttggttttgttattaatattgtgcgatttttagtaaattattttgtttgtttaggttttgtttttatttttatgaaacgagggcgttaaattgtatgttataaataatgagggttattagttattaagtttttattttaggttaggtattttttatatgttattatgagtttttttaatttaggtattgtttttaatggatagtttagttaacggaagtttagagaggtggtgtaatttgttaaaagttttattatttagtgaatgtttttacggggtttgtatttaggagtttgatatagagtttaggttttagtatttggcgatgttttgggggtgtgagtagtttagtttattttgggtacgtgtttatttgttgttttttttgttttatgtttgtgtttgttttttttgaagtttagattgttattttttagttttaaatattaaaattggttaggtacggtggtttatgtttgtaattttagtattttgggagattaaggcgggtggattatttgaagttaggagtttaagattagtttggttaatatggtaaaattttatttttataaaaaatataaaaattagttagatatggtggcgtgtatttgtagttttagttatttaaggagaatttagttatttagttattgaggtacgagaattatttaaatttgggaggtggaggttgtagtgagtcgagatcgtattatttttttttaggttaggtaataagtgtgagattttgttttaaaaataataaataaataaaataaaataaaaattaaaattaaatgttaaaattaatttataaaataaattttggttaaagtagtttgtttattttgttttaattatgtatattgtattagattttgttaggggtttagcgtataaagatgagatttttgttttgttagataggtgggatgatggttatattttgagttagttaaggtattatttggttgtgtaataaaagttaaaatattagaggttgagtagtattcggatttacgttttagtttaagtgttagtcgttatgggggtttaggatagttcggatttagtttatttttttggtgtattttcgatatatagtttttattttttgagttgagatggttttagtttttgtcgttatgtttgtattttagttagagggaagggaagaagggagaggggaaagggtaagtgtttttttttatttttaagggtatgatttgaaagttaaatattttagtttttttttattggttagaatttagttgtatggtcgtttttgttattagggaggttgagtaatgtattttttagttgggtttttttgtgtataattaaaattttagttattatagaaaaaagggagtttagatattggggaaataattagtatttgtattatatgtattgatagttttttttgtatgaatagagttgtggtaggttttatgttagggagaaagtaagattggaaaagagtttattaaggaggtggtatttgtattgtgtttaaggggtaagaaaaacgttttttaattaggagttataaatgtttggttgaagtgttattgtttttttattttggagttggaatagacgttattagttaattatgatggttgttgggtgtattggttaatatttataattttagtattttgtgaggttgagggtgggaagattgtttggggttaggagtttgagattagtttgggtaaattgtaagattttgtttttgtaaaaaaatataaaatgtagttgagtgtggtggtatttgtagatttagttttagttattcgagaggttgagatgggaggatcgtttgggtttaggagttcgaggttgtagtgagttatgattgtattattgtattttagtttgggtgatagagtaggatttgtttttaaaaataataaaataaaattaaagttttaaaatggaaaaaaaattatgagtatataattttagatgtatttttaagatagtaaattcgggtgggcgtagtggtttatgtttgtaattttggtattttgggaggttaaggtgggtggattatttgaggttaggagtttgagattagtttggttaatagttttatttgtattataaatataaaattagttgggtatggtggtgggtatttgtgattttagttatttggaaggttgaggtaggagaattgtttgaatttaggaggcggaggttgtagtgagttaagattatattattgtattttagtttggagaaaaaaagtaaaattttgttttaaaaaaaaaaaaaaaaagtaaatttagggttaggtttgtagttatatggttatttttttttttgagtatggaggtagttttagaaatttgttttatattatattagtgggtagttgattgggttagtttgttagttgaattttatttgttatagttattttttatagtaaggggtattttagatatatttttttttttagggaagaataagtcgtagttgtttgagcgttttatttagtggtgtgtatgtttttttttaattttgtgtttagtgatgttttgtttgtagtttgaaatttgttatagtgggtgtgtttatattataggaattggtaaatattatatattaggttttattttttgttttttattagggtaggttgttttttttttgttgtttttgttttttgtttttttttttttttgagacggagtttcgttttgtcgtttaggttggcgtggagtgatgcgattttcgtttattgtaagtttcgtttttttggtttatattatttttttgtttgagtttttagaatagttgggattataggcgttcgttattatattcggttaattttttgtatttttagtagagacggggttttatcgtgttagttaggatggtttcgattttttgatttcgtaatttgtttttttcggttttttaaaatgttggtattatgttattgcgttcggtttagggtaggttgttagaaatgtattagtttgttagttttagttttgtttgttttttattttttttttttttttttttttttttgagacggggtttttttttgttgttttttaggttggagtgtagtggtgtgattttggtttattgtaatttttgttttttgggattaagtgatttttttgttttagttttttaagtagttgggattataggtgtttattattacgtttagttaaattttgtatttttagtagagatggggttttattatattggttaggttggtatcgaattttttatttaaggtgatttattcgttttggttttttaaagtgttgggattataggcgtgagttatcgtattgggtttttttcgtttttttttaatgaaaatttttttgaaagatttgtttattgatgtttgtgttaataggtattgtttgcgggatagagtttgttttttttttgaaggtttttttttgtttgggtgattatttgtatgttattttttgttgtttagaattaaagatgtagttatgtttggggtaggttgggaaaatttgtgggaattatagagtttgttgttatgttgtgttttggatatttgaagtttggtaggtaggtgggatcgagggtgggtattaggaaagtgatgtggttttataggaaggggatataggttttgagattttaggtttttaattggataaagttgttttttttttttggataaatgttttagtttatttataatcgagtggttagtttttttttttttttttttttttttttttttgagatggagtttcgttttttcgtttaggttggagtgtagtggcgttatttcggtttattgtaagtttcgttttttaggtttacgttattttttcgttttagttttcggagtagttgggattataggcgtttgttatcgcgttcggttaattttttgtatttttagtagagatagggttttatcgtgttagttaggatggtttcgattttttgatttcgtgattcgttcgtttcggttttttaaagtgttgggattataggcgtgagttatcgcgttcggttaagtggttagtttttttagttgtcgggttttgtatattttgttggttttggagattatatgtattatgtagattttatttgttttttatttttagtgttgggggaggggttaagggtttgtcgatgtgttgatatttggttatttattggttttgaatgtttatatttatttttttgaaatcgatgtttcgtatcggaggttttatgtggatttgggggtagaggtttgtattttagatggtggggtggtttttattaattaggtagattttttgttttgttttgttttttgggttttgtagttttagatgtgtgtttaagatttgtggttatatggatgggataagttatagagatttagatttcgtggtttttgtgattagagtagtcgtggttttgtttgggaatgtttttattttgttgttgaaggtgagaaatttttttgtgttggagaatagttgtgttgagaagttggtttatttggtttgtaggattgttggggtaagggaggtttgttgtcggttttttttttttttttttgattgggtgttttttgtttaggttttttgtagtaaaagaattttttaatttattttgtttttttattgagtttttattttatgaagtttattttttaattttagttgattggtttttatttttttaagaggaaggttaggggtagacgaggttgaaggaggttgatttttttgtgttttcgtagtttgagttgatgttgttgtatgtttatagggtttttttagtttttaaaaaggttttaatacgttcgttatacgtttgtggtttttttggatgttatattaatttagtaaggtttgagttagaggttgtttttgaggttgtgaaaatagaagaagggtttagaggagaatttttttatttgacgattttaggaaggttttttagaagaagtagtttttgagttgagatttgaagatagattaggtttgagttaggttagggagggtgtgaggggtttattaggtagagggaataggatagggtaggtatagaggtttggtatttggtttgtggggaagtgtgagtttttgggtatgattaaggcggggagaagtggcgtgagaggaggtagatgtggttggtaggagatcggcggtttcggttttgttgagttttattttgtatgtattaggtgatagaggttgtttaggacggtgggtagggaagtgataggttatatggttattttattaatagtcgggagtttagtttggggggatttaagattttggggaaggtacgagttaggggtttgttagagttaggagttagtgggagaaggaaatagtgttgtttatgaattataaatagatattttcgtaattttttttgacgtgatataattttaaagtgggttatttagaggtgggaaggtgatttttggttttttaggttttgggtttgttttttttttttttttttttttttttttgagatggagttttattttgttgtttaggttggagtgtagtggtgtaattttggtttattattatttttgttttttgcgtttaagtaatttttttgttttagttttttgagtagttgggattataggtatttgttattatattcggttaatttttgtatttttagtagagatggtgttttattatgttggttaggttggtttcgaatttttgattttaggtgattcgtttattttggttttttaaagtgttgggattataggtatgagttattgtgtttagtcgagtttatttttaagttttttttggtttttagtgtttttgtattagtttatttttttggttttttgtttttaagagttttttttaagattgtttttaagtggataggtttttagaattaaggagtagttttaggagtttttagttatagatattttagggggttcgtgtggtttttagtttttggtttggtttcggtagttttggttttttgtgttgttttttatatagtttggttagagttggttaggttttttggttgggtcgagttatcgtggttagtgatttatgtagggggagaaaagtgaggagggggaatagagtgcgagggggattgtgttaataataaatttattaggtttttgaggttattttataggagggataaatggtttatttaggttgatttggttgtcggttggtttttagagatatttagggtggggaagattttattatttggggaaagtaatattagattgtttggaggggtttagttagcgtatttcgcgttttttgtttgttttttacgtagagcgttttgtttttaaggcggtaggttaagagcgcgagtcgaggtttaggtgtaaagaggggtgcggtatgggggtattgtagggtacggggtgtatgtatttttatttatttttttattgagtgttagggtaatttgttaatggggtatatttggtgatataaaattttttgtcgatttatggtagtttggaacggagtggaagcgttttatttttggggaatttttatatatatttggttgtgaacgtcggtgtttttgtattggagtttttttggagtgtgttgggtagagcggagaggtttttttttttttttttttattattttgtggaggtgttaatatgtagttagagatggttagtggtagtgaggagaggggggtaggaagagattagggttgggggtttgttagtttatagttttatttttgaatatttatggtttttttgtttaggttagcgaggttgggggtagagacgggtaggggttttttaatgttgggtattttttcgtttttttatattttggatttgttttttggagaaagttttggagtatttagaagttttggggttgttggttgaggtggggagtagagtttagttgtgtttggaggttttttatttttatttagtttttagggatagttttagttgtgtaggtttaggtcgttgaggttggttttagaaatttttttataattattattggatggaaaattagttttttaaagggttttagagttagttttgtttttttttttataggtttttatagttagagtatcgggtttttgttagagatgtagaagagacgatgtttttagtttttatgtggttcggtttttattgtggatgttggtgattttagttttttttttaaaattaagagggttgatgttttatattttaggtttttagaaagagtcgttatttatttatatcgttatattttttttttatttttttgtttcggaaagagtagagtggatatgcgtttttgtagaaatttatttatagtttgattgtagatgtattttgtttttttattgagtttttgttttatgaagtttgttttgtttgtatttttttttttttttttttttttttttttttttttttttttttttttcgtttttttttttttttttttttttttgttttattttttttttttttttttttttttttttttttttttttttttttttttgttttttttattttttttttttttttttttttttttttttgaatagttaaagatagaatgaatggtataggtaggtattgagttttttgtaattggaggtgtttaagtgtagggtggatgggtatttatagggtaggtattgaggaaggatttttttgggattgtggatggtaggataggttttgtggagttttttgagcgggtgtagaagagggagggtatgtttttgttttttgtttttttcgggttgttaggtcgttatttttaatttttattttttttttttttatttgttgggttttacgggatgggtagaggtattgttagaatatggagtcgcggtttatagagggttagtagggaggagagttttttggggattacgtcgttttagttattgtggtgattttgaaaataaatgtttttttttttgtttgagtttttgttgtttttgttgacgtggaattagggtaggttggtgatttagtttttatttttgtattgtatcggtggtaagttgtttttagttttagattttatagagtagggtgttttttttagaaaaatagtagggaggttaggatattaagggttttagggatagtttgttttttttggttggtatgagttttagttaagttttttggtattttgggggtgaggaggtattagttgtgtgttttagttattggttgttttgaggttgggtcggtgttaggttggttatttttttttgttttttagtgtgattttgtagagttttcggaagggttagagggtttttttttattattggtgtttatgggatattgtgtttttattttatttttgtattttagttttagacgggtgttaggaagttggagattttagttattttacgattgtgttttgcggggttggagtaggaataggagtaggaggaacgttttggttatgggattgtgtgaagagagaaggattaggaagaaaatatgagttattatgtttgggttatattttagtagagtcgttggtggttttttaggtatttgaatttattaattataaagtttattaggtgtgtaaataaataaatgttgtttaggaggtatagttagggttttgttggagagggattattttggaggggttatattttttatttagttttttagtttttttgttttgtgtgtgtgtagtttttgattattattatttttgtttttgttatttgtttttagggttttattaggttggatgttattgtaataaaatgtagtaatagaaggtttaggtagtgttgtagtttttggtggtattattagagttagtaggtagtagggttggggaattttaagttgatttagttttaagtgtcggagcggggagttcggatgaggtgggggtggggaatcggggagttatggagtagagtatttgttgtgttgaaggttaggagtttttttgggagattatgaatttagaatattaatattttgtttaaaaagttttttgttttggagataagagtttaggtcgttgtggttaggttttgttgtaaatgttttgtataaagtaggttggggggattattgggaagtttggggaatagattggttatgtgtttttttgagtgaaattttatggttgtattgaagcggttaggtagagggtgtgatggggtgtggtagttgtatatcggtttagttaggttgaatggggaaatgtaaatttaggtggtttgaaagagatttagtggtttatagtttggtggttgtttttagtataggtgatgtaaagagagaaggggtttcgggggtttggtttaggtggaaattatgtattgtttgtgattttgggtatgtcgaggttggagtaggtttgtttggtggttggtagaacgtatatgaagaatttatgtgtgttttgaacgttttttttgtttttttgggtttatgttttattaggagtttttcgattttgttattttgtaaaggaaattgcgttttgttattgtataggatcgaataggtgtgtgtggagtttttaaagttattgttttaaggggttttatgggataatgggagagttgttgtgatgtttaagattaaagtgatggttgggcgtagtggtttacgtttgtaattttagtattttgggaggttgaggaggatggattatttgaggttaggagttcgagattattttggttaatacggtgaaattttatttttattaaaaaaataaaaattagtcgggtatggtagcgggtgtttgtaattttagttattcgggaggttgaggtaggagaattgtttcgatttgggaggcggaggttgtagtgagtcgagattacgttattatattatagttcgggcgatagagtgagattgtttaaaataataataatgttaataataaataaaataataataataaaataataaaagtaaggatttgaataaatatttgtatatttatgtttgtagtagttttatttttaattgtttaaatgtggaaggaatggatatataaagtgtgtgtatatatagtggaatattatttagtttttaaaaggaacggaattttgttattatatgtgaattttgaataatgaattttgaagattttatgttacgtaagtttgttttataaggataaatattgtatgattttatttatgtgaagttaaatttatagagaaattggaatgacggttgttagtagttaggggaaggaaggatggggagttattgtttaatgaggatagagttttagtttgggaagttggaagaagtttcggaggtggatggtgttgatgggtgtataatgtgaatgtatttaatgttattaatatggaaatttggttaaaatggtaaatttgttttttttgtttttgttttttttttttttgagacggagtttcgttttgtcgtttaggttggagtgtattggcgtgattttggtttattgtaattttcgttttttaggtttaggcgattttcgtgttttagttttttagagagttgggattataggcgtttgttattacgttcggttgatttttgtatttttagtagagatagggttttattatgttggttaggttggttttgaatttttgattttaggtgatttatttattttggttttttaaagtgttgggattataggcgtgagttatggtggttggttaaaaatggtaaattttatattatatatattttattatagtaaaaatgtattgttttattagaaaaatgatagatttttataatatgaattaaattataagttatgaaggaaaaattaagtaaaatattaaaaaattatttataagtaattatatttaaaataaaagataataaatatataatttttattattttttaggttttttgtaatatttaattattgtttgttttgttgcggttatgtttttgaggttgtatttgtatgatagaaatattatattcgtggtgattaaatatttttttttagttttatttttaatgatgttatatagataatttgaaattggtcggttgggtacgatggtttatgtttgtaattttagtattttgggaggttaaggtaggtagattatttgagtttaaaattagtttggttagtagggtgaatttttatttttagtaaaaatataaaaattagttaggagtggtggcgggtgtttgtaattcgagttatttgggaggttgaggtaggagaattatttgaatttgggaggtggagtttgtagtgagttaggattgttttattgtattttagatcgggtgatagagtgagattttgttaaaaaagaaaagaaaagaaagaaattggttaaggtaggaatattgatattataggaataggtaagcgttataaatcgggaaattgagtgttgttgtttttgttggttttaggtggtcggttgttgatcgttaattggtatattattggaggagggaggtttagattgattcgtagagagattagaggtagaaacgtattatggtttggatgttgagggtgagggaaagagaggagttaatagtggtgttcggagatttggtttgagtaattaggtggatggtagtatcgttttttaagatgaggggttgtgggaatttgaggggttgtggaaggttttgttattgacggatttagggttcggtagttttgggaggtttattttgtgttaggttacgtagagataagattatttgggttttgtttttgggaagtttttgtttatgaggatatagtttgttatttaatggggtgtttcgtttggagttttagtgttgttgggagaaagttttttattttttttcgtttttcgagttttttttgtttttttgttagttgagtttttttatggaggttgtgtttggaggggggttatggatatggatgtgtgcgttaaacgttgttttttcgtggattttttttttatttcgtttttacgttttgtaagttttattttttcggggtttgatttgtggggtttttttttagatttgtttttttttatttttagaaaggcgtgtaggggttttttatggtttttttttttgtttttatttttttttttttgggatagtgatttgttggacgggtgggttatttatagggtttgtgattgtttagatatttttgttgtatgaagttttgattttaaggtatgatgtagatgggaataaggtacgagttttttttggttgttgtaataattgtcgaaattgggtggtttatagtaaggggaatgtgtttttttatagttttggaggttagaagtttgaaattaaggtgttagtagggttagttttttttgaagattttaggggaaaatttttttttgttttttttagtttttggtggttttaggtgttttttggtttgtggttgtattatttcggtttttgtttttgtttttataaggtttttttttgtgtttttgtatttttttttttgttttttagaaggatatagtattgaatttagggtttattttattttgagatttttgtttaaattttttttgtagagatttttaaatagaattaggttatatttgaggttttaagtgggtatatttttgttttgggggggattatcggtttattgtaggtttcgttgtgtattgaagacgtaggcggtttttttggttaggtttgtagtcggttttgtttttttttgtgatcgtggaagaatgtattttgttggatgtataggtttttatagtttttttgtttttgttaaattttagtttagttttttttttgttgtcggcgtgtattttttttgtttagtgttttttttgggattgtgtgtttaggttttgaggttttagaaaaggggggtggagggtttttttattattttgtagtaatgaggttttattaaaattttggagttttagattggatttagtttttagttatgattaaaggatagttcgggatatgattaaagggttagagaaagatgatttaggttgagaaagaggaggttaaggagtaattggattgtttttgaatgtggaaaaggtaattatgatttgaagggtggtgtttagttgttttttattttttttgaggataggaaaaaaaaggaaataaatgatgtataattagagtagttggttagatacgagggtgaattttttggttgggagtatggttaagttttgatttgggttttttgaaagagttcggggaatttttttatttggaggtttttaggtttggttatgtggttttgagtgattatattgaaggggtagtggttggggttggagtcggtgggttttgagtatagttacgaaggtatgcgtattttttggttgtttttttgttattgttttttgggtttttattttggtgaggcgtgtattttggcggcgttttttagggaattaaatatgtttgttgtattgtgcgtggagatggagaatgtataattggttgattttgtgttaatttggtggaattttatgttagttttgggaaagaataattgtatgggtgtgtttatatttattaggtgttttttagaaaaatattcgagaataatgttgtggtttaggatggttgttgtgtcggattcggtatttttttaggggggttgtgttgttgggttgagttttttaggtattggatttttaaatttttaaatacggcgtggataggtggtttagtaggggttggattattcgataggtttaggtgttggagtttagataagatatattttggtttggcgtggaagatacggggtgttattaatggtagtaatggttgtatttttgaaattcgggtttttaggtcgacgagggtgtgtacgtatttgaaatgtttgtggttttgtagtttttatgtttataaatttatttggttgaaaatagtttaaaatatttaaagtatgagggagggagtgtttgttttttttaaaaaggaaggatttgattttatttatttaaaaagttatttaaatttagaatatttttcgtaagagattttttgtttttcgtttttttagaatggttggagagttttagtatttttgtatatttgggatattttagagggggtggggaggggtaagtgggtagcgagcgattttagatttaggatgagttgttaggcgtttttcggttatatatttaagggatcggagtgtagttgtagcgttgcggtttgttgtttcgggggtgggggtgttgttttatgttgtgaatttttatatggtttttgattttgggtagaggtcgagggtttaagggacggggtgatagggagagtatgtaggagtgggtttttggttttttagggcgagtggaagaagcgttttttttttttgtaggtgatagatttggggggttttttttgaggatgagagtttgttgttttttaagttttgtgtttaatttaggtttttaggtttattttagtttttcggttttgtttgttttgtggatgatatagtttaagggtagagatcgttggtttggagggaaggttaggttttaggttagggtttagaagggagggagaagtttttggggtagttttttttttgtttatttattgtttagtttttttttttatattttttttcggaaacgtttgtttttgataaggtttattttttgtttttaggaggtttttattgtggaggaagggaggcgtcgttcgtttttggtttttttgatagtcgtgttttattttcgttttgtgttttttttttcggatagtgttttttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcgcgggcgcggcgttttagttagcgcgtagggttcgggtttcgtcgggggcgttttttcgtcgttgtttttcgcgcgattcgttgtttattagttattatgtcggatttcgcggttaacgcgtagttggatgggattatttcggatttcgaaggtgggtgttgggttggttgttgcggtcgcggacgtgttggagaggattttgcgggtgggtttggcgcgggacgggggtgcgttgaggggagacgggagtgcgttgaggggagacgggatttttaatttaggcgttttttcgttgagagcgtcgcgcgttttcggtttcgtgttcgcgtcgtttacgtgggggattttgttaggggtattcgcgtagattttgcgcgtttttataggattttgtgttcgttttgcgtattgtcgtttgggtttttttttttttattgttgtttgtgtttgttaagcgatagcgattttttcgagggttcgcgaggttgtttcggaattttttaggacgtatagttttattttgggaaatttatcggttttttttttttggtttttttcggcggttttcgggtttcgtttggattcggtaacgggatagggaggtcgttttttattttcgattgagtggatagtcgcgttttgttcgggtggatagttttttttttttttacgttagtttcggggtcgttaagttgtgtagttcgtgggtcgggagtatcgaacggatatagtttaggtcgtggtagggtttagagtgggatgttttatggtttttatttaggtttggggatatttttattcgttttttagaatcgggtcgtgggggatagaaggggtttgcgtgcgggtagggagagtattttggtttttttttgttttcggggtttataaagtgtgttgggatttgcggggttgttttgtttaagtttgggtttggcgttcgcgtttttgagtttgtgagtgcgtgcgtttttttgcgtttttttgattgtcggtgttggggttttgcgttttgcgttcgcgggagtaaatatagtaggcgaaggggaagtttatataatggtttttagcgttttggggtagggtttttgaggggcgggtttgtttttgtcgggatttggagttttcgtttttcggagaggtttttaggttgatttgggtagagttttttggtgggtcgggagggggaaaggttgtgttgaaatgagtaaattgtttaggtgttaggttaagttgggaggtgattagtttgaggtttttttcgttttatggttagaattagggttgatatttgggtgttttgagtttagttgtttatacggtttatttggggttagttttatttgagtgggggaggcggggttttttgggggattagaattttggttggacgttaagtagagtgttagtggttgttttttagggttgggtttgaggagggtgtggggcggcgaagggacgggagggggttgtgatttagtggttattggcgttgtgtagagtgtgagttggaaatatcgtagttattttgttagtttagtggtgaaagtttttttttaggttttatttttttgtatttttgttttttagagggaggggaggtttgggtttgtagagttgggagggtttgttgttttcgttttttttttttataatatttttttatttggatatttttgggtatatgtttatattggggtttttttaggtttattgtgtttcgttgagttttttgtagttttcgagtgaatgtgatttttttgtttttgtttttttgtaatttttttttgcgatcgtttttttaggggttttttttgttttaaatgtttaagtggtacgatttagtcggtttgattattttttagtaagtttttatggagagaggttttgtgttgtgtagagttttttttttgtttgcgggatcgaggtttttgtttttagtttttaatagaaagtgtcgggtttttagtgggatttttggggaagaattttcgtgttttaacgggagttttgtggcgggaggggaggttagggtttggggttgtgttcgttgtatagttgttattatttgtattatgaaagttgttagtgttttttttttgggtttttgggtgtaattttatttttgtttttatgtgtttttatttggagttgtttttgcggttgttttttaagttagttttgtgattttgtaatttagtttaagataatgggtttattgagattattttggtgtagtagttggtaattttttggttttgggggaaggttttttagtttcggggagtggggttttaatttgttggttttttgtgtttattagttttttttttgtgtgttttgaatggttttgttgggaattttggttttagagttattaggtggttcgagtcgataggcgtgagagagtgtgtgtgtgtatgagtgcgtatgtgtatgggggttgatttggggtatggaaaggtggttttttttggtgtttaaggagtttggagtatagttggagggtgtgggggtgtgtatatgggagttggataattttgggtggatagatagacgtggggaagggatgattgaaggaggtggaggagagagtgtgatttagtttagttaggggtgatgtggataggtagttttcgaattagggtagagaaaagttattattagttagtaggggagaagttagtatggaggaggcggattttgagggagagtaggaattggattgtaagaggaaggagagttttttggttagtagtagttagtagtagtgggggaggttggaatgagttggttggagagggggttggggtataaggaggggtttgtttgtgaagattatatgggttaggttgcggagggttaggtatgttcgtcgggagtgtagttggtttacgggaagtatttggagtggttgggaatgggcgtaggagtagcgtcgtgggagtataggtttttttttcggggcggtttatttggtgttttggtttttgtaaggtaggtcgaaagggtggggaggaaattgttagttttttatagcgttgggatggtggttttagggtttttgaggttagcggatgtgggtgtttgttattatgtgggttgttgaggggcggagattttaggggttattttaaagtaggacgagttttgagttacggtatttttgggggtagttttttaatcgagtagacgtttaggtttggaattttgtaatagaggttatagggttttgattagggtgttttgggaggtttagaattagtggtagtatatagggtagacggtaagtgatttggtatggggaaagaggtaggtgtttaggtcggtatagtatattcgtaaggaataggtagacgggaagtcgttcgtgggtttgtgtgtgtgttcggagttaaaattttgttaatgttttatgttttgggtatatttattttttttttggggagtatttttttttttatttttttttttttcgtttgttttttttatttagggttttttttatttttttcgttttggggatcgagggtattatggttttatgttttattatcgatgagttgtatagggatttagttttttcgttgtttaggtcgggttttttaggtttagggtttttaggaatggagagggtattagtgttttttatggatttaaatttttcgtatttcgtttttgttttttttttaagataggttttcgagttttaaggttttagggttttgtggaggtcgttacgtagtagtaaggagaatgttttgtatttggttgatgagatttttagagttttattttttatttttttattgtataaacgggtttttaggcgattgtagtattcgttattgttcgtaatagggtgataagagggatgattttttttttttttttttttttggttggtggaggtacggggttggcggacggtatgtgttttcgtgaatttaggttaaatttgttatcgtaaatacgattataattcgggtttttgtgtaataaaagtttttttaagtattagttgttggtttgttttgtttagcggtgtttgttgtaattagatttgtatatcgagaaagaatttaaaagtttttgatgtttgttgaaataatttggtttaggatttacgtgtttagattttagagttgtgtggtatttgagtttttttcgagtttttattgtcgttcgaggaggatttttagatttgtgttttggaggtagagtaggttgtgggacgggtttttgggtgggaaggattatgtggatatgtttttttgtttgagagttttaatattttcgggacgtgggagttggcgcgttggtaggatttaggtgttttttttttttttagagaaaaaggtttcgttgtttggtaataggtgtagatttgtttttaattaatgttagtaggttttttgcgtgatgaattttgttttttagttaagatttaaggtattttgtgaatattgtttttttgtagtttgagtttttgtggtgggaggtaggagttatggggagtgggggtaggttttttatacgggttttatagttattggtagtattgatttgatgttttttgagtttagagtttagggttagatagatttattgtttcgattacgagttggtttatttagaggggggcggatatagtatttaggtagtagatgtattgtgattagttttgtagcggggttgtgggttttttgggttggatgttcgggaagaggtaggtggaggtaaacgttaggatatttttgtagtgattgggtgattgtaggttggaaatgttttttgtgggttgtggttgtttaggaaggttttgaatggggttagtggatagagtttgtatttagaggggtagtgttttggaggagtgaggggtatggtagtgtagggatgtttaggtcgtttttattttgttattggaaagttgggcggtttcggtttttttagttttttcgtttgtttttttgtttgtaaagtggggttagaaatagttttttttgagggttgttgggggattttgagatgtagtttatggcgttgagtacgggttttgttttttacgggtgtggtgggtgtcgcggttggtgtggtatttgggcgggaaaagggggtatttgtaaaggataggtaggtttggatgtttaaatatgtagatttggggatgggaggttttaggtaagggtttgtgtgatgttattgtatgaatgaggtcggatagtatggttattattaattatggaaagtacggtagatattagtgttagtagcgttcgtttgggggtttttttgagttcgataggtatttaggtttttagtgtagttatgggatttttttttttttgtttggttgatattttggaggttggcgttatgttggttgtaggttttttttattgggaggttgttttggttttttttgttattatttatttttatttttattttggagtgttatagatgggtggattatatgtttatttgtagggttaagcgttgataatgaggtgagtatttgttggatgatcggattatgaggatagcgggggcgttggtagtttgcgttcggttttgtaggttggtttttttttgaaaagcggttgtggtagagtgtgtattttagggagtggtgtttgttgttttgaatatttttatttagtaggtttttgtaagggtttagttaagtgtggtgtagagttgggttggtagttggaatagttttattttgtttagtggtgagattaagggttgatgggttaaggttgcgtgttgtttgtttagttcgtggatttatttattgagtatttttatatttttatattgggttcggggtgttaggaggtggaggggggattgggtgtttggaaaaataagtttatcgagagtttgagtttttaggggttagtattaggtagttattacggtgttcggtatatagtggttatttggtttcgtcggttgttttggtggtggagagcgtgtatggtggtcgtacgtgatgggtattatttagggtaatatagatatgtagattgtgtatttgtttgtaggagttagggattttttagtttggtaatttgtgatttttgtttattcgttgggagagaggtgttgttttttgatagtttggtgtcgggagagtagaattagggttttttttttttttttttattttttattttttatatgtttaggtattaggggaggttatatttagggatgagttttggttattgggtttagggttttattgttgttattttttttttttgttagttagttaaatgttcgtttattatcgtgtcggggatggggttggtttgtttttttgaagtttttttggtgtatagtttaggttggagtttcggacgatttcgttattttttttttcgattttttttttttattttgatttattttagaaatttagttaaaaattaagtttttgtgtttttttttgataaagttattgaggaaaaatggttaaatattgtttttttttttaaagtttttttggttttttttaaatttggaggttttgagttgtttatgagattaaagggttcggaattttttggaatatagttttagaagtgggaggatttgttatttttttagttaaatagatttattagttggtttttagatatttttaggcgtttggggtatttttgggtttaggttgtttaatttggtttgtagagtttcgaggtttcgtttagattgggttagtagatagttttagagattttaagtttgttgtcgtttttaaaagttttgttaatgtttagaaatttagagggataagaagatgatttcgatgttagtcgggattataaatagtgaggttcgtttttttttttatttatgtttgtttttattgttttcgtagttgggtttttaggggattgttcgtggttatgggggaggtcgggaatgcggggtttagattttattgggtttttcgtatttttttgtttttttttgtttattttttttttcggaaatttttgaatatttttttatagtttttggtattttgttatttttggtatttttgggttaattgggaaagttattatttgtttaatatttagaaaattaaggggtttggttttaaatatattgtagtgtttttttttttatatggtatcgaattttttgtgtttttaaagttaggagtttgtgttttggatgtgggcgatggagttttgtagatatttggagcggtttttttgggagagtttttttcgtttttttatttattcgtttttttttttttgttttaagttttggttatagtttcggaggggttatttgagtgtaggttgtttttaggtgtatagttggaggggggtagttattttatatttttttgtttgttaggggtatttttagggatttaggttttgagggatagcggaagggtggggtggggagtaggtcgttgtttcgtgttatttgggtgttatgtagattttgaatgggtagtttttgggagttggttttttttttttattttttttatagtgttgtttttttgaggggttggagttttttggagttttttgtagtttgtggtaggtttttttgattttgtgtttggtttcgtagtttttaatttatagttagtggtatgaagaatatttttggttgtttttatttgtggtttttgtaggtagtagttttttggggtagggtttgggggttttggtatttttttgtgggattttttgggtatgagggagggagttatttgggttatagatagattttttttttgtatttaggaggtttaggatggatttgttttatttttttttttggtgggaagagagtatttttggttatggggaatgtggtttggatagagttatttagtttttttttttttttaggtagggttttgaaagatggagatggttttgtttttgttaggttaatagttagtagtttggtggatttttatgtagtttaggtaggatttttttttgtttttattttttattttatgtgtaggaagttggttttaagtagggatttttggtttcgttttttacgtgggtgggtagtttttttgcgaggggtaggttaggtttttgttttatgttttttagagatcgatgttatttatagtaagagtatataagtttttttggttttaaattaggtttggaggggtggtttttttttttgttttttgttttttgttttttattaaaggttagggaatggagtgttttgtatgtttgttggggttgggtttttttttttggtttaaaatgaagggttggaatttttggtgtagattgtacggtgagaggtgttttttgggatttattcgaggagtattattgttgaatgttttgttaggttaggagtatcgttgggggtgggagaggtagttggtttatttgtttatttaatagttatttatgggtattttaagggttagttttgttttaggtattgggggtttaggtatgggtttaggagaaggggtagaacgggagggttttttggaggaaggttttttaattagagatcggggtaggagtttgttaggtaggtgatgttggttagttttttttgttattttttttttttttttttttttttttttttttttttttttttgagatagagtttcgtttttgttgtttaggttgtagtgtagtggcgtgatttcggtttattgtatttttcgttttttgggtttaagcgatttttttgttttagttttttgagtagttgagattttaggtacgtattattacgtttagttaattttttgtatttttagtagagataaggttttattttgttggttaggttggttttaaattttttattttaggtgattcgtttattttggttttttaaagtgttgggattataggtgtgagttattgcgttcggtttttttttgttatttttgtagatttatagtgtgtgtggaagattgtatgtttgtgtttggtatagttgttttcggtatttaggtgggaggtgggggagagggttgttggtgttagtataggttatggtatgagataggttttcgtagttaagcggggtgtatcgtagtattggaggggttttgttgcgtacgagatttaggttttgtatttgtttttttttttaggaggtttggagggttgggagggattagggtggtgaaataatttaggtgggagagaggtattgttggagaggtagagggagttgtaggtttgtagtagcgagttttaaattttgggtttttattagaaaattttagaaagggttgttttgtttttttttttaaattataaaagaaatttttggtcgtttgggttttttggggtcgggtgggggaggagattttttattcgtatttttgtaggtttagtattgtgtagagggaggagggtggaggtaaaggcgagggaggagggtggaagtaaaggcggggtttttttttagtttcgttgttttgtttggttgttgtttttagatttttatttttggttcggaaatatggaattttgggatagttggggtagggggtatagaacggagattttggtgagggaggaattttttttttagttttggttgtggttatagtaaggttaggttgggaggattttatttaaatatttatattttttttaatatttaaatgatgaagtaggtttttgtatatagttgttttggagttagttgttgtttgttttatttttttttttttttttttttttttttttttttttttttttttttttttttttttttttttttttttttttttttgtattttttgtttttgatttaagtttaggtttttttagttgttttttttttatttataggtattttttgtgattgagtttttttttgttattttttataattattttttttaattgagtattttttaggtgttaggttttgggttggtattttgtatataaggtgttttttaatttttacgagagtttaataaggtagattgggttgttgaggttttagcgttggaaggtcggttcgggtttttttagttcgtatttgtatttatttattatttttttattgtggagatttgttttttggtttttggttgagtacgatggaaatttttgtttattagtttttggagagtggggatggttgagggtttcgattttggggtttgacgggggttgtttttgttttattttagtttggttgtttttttatttaatgattgagtttgtaaaattagaataatagtgttatttggttggtattttgggtggttgggaggcgtgggagagggtgtacggaggggttgagcgaggtgttagtatcgtggggattttcgagggtagtttttttaggtttagggcggagtgtaggtagagggcgcgatggtttagcgtgtcggtttatatttggttttgtttttgtttatacggtaatgtgggggagttattagttttttagtgttttagttttttatttgtgtaatggggataagagtaaattattgtttttaggtatggtaagtatttatatatattgattattgtagaatgaatatagtgagttttttttaggtttttattatatgttaggtagggtgttaggttttagtggagaggggataatgatgggtaagttggtttttgtttttaagggttgtcgagtagggaggaaggcggcggttgttttgattgtgattcggagtggggtgattcgtaaagaggttggcgggaggttggttgggggttggttgggggttgtttttttttttgtttgtgtttcgtggtagggtattaaattggttttttttatggattttcgaggttttgattgtgggatttcgggtaggttttgggattttgtgattttgttttcgtttgttatttaggtttttgtttttagtagtgtttagtatacggcgatttttgtatgttttttagtgtgtgattgattttggagttgagatttggtagttgaggttggatattgtttttggataattttcggggaggtgggggtagggtggggttgtgagttggtaatttcgagtttttagtagttttcgaatggaggttttttttttgtaggattttcggggaggaaggaggggatgggggagatgaggtttgtgagtttttaggagggtagaggtttatatttgtagcgttttagaaatatttcggggtgtttaggtttatttagtttttttgagttagaattattaagagttggggattagtagtttattttttagtaagatttagaaatgatttttttgaatagttcgagttaagaatgatatatttggaattagaatattagaattatagaggaatcgagagaacgggtttaaaatgtgtagggattttagttatatggcgttatatggaggaaagtatttaatattattattgtatgaatttgtttaaatatatatatatatatatatatatatatatatatatatatatatattttttagtaaagagtggaaagatatttgttagaatattgatggaagttatttgggttgtgggtttatagattttttttttttgtttttgtgtattttgtaaattttcggttttgtgtttaaattttttttatagttaggaataaagtaatagatgttattttttaaagtttatgggttcgtgttcgtaattttaatattttgggaggttgaggtaggaggattttttaagtttaggagtttgagattagtttgggtaatatagggagatttttatttttttttttttttttttttgatagagttttattgtgttttaggttgaagtggcggtggtacgtttttggtttattgtaatttttgttttttaggtttaggtgatttttatgttttagttttttgagtagttggattatagatatttatatttgtaggatttgagaattttataagaggaaagtttttattcggaggttgttggggatttggagttgttagtttatatattttttagtagagatagggttttattatgttgattaggttggttttaaatttttgtttttaagtgatttatttatttcggttttttaaggttttaggattataggcgtgagttattgcgttcggttatgggagatttttttttaaaataagaataaaaataaaaataaataaaagtttattgttaaaaagaaaaatatattatttaatttaatttttttttaggattgagagatgaggaagtagaggtcggaaagtgttatattttttggtcgttggtagttaggggatttgaggtttgggttggttttttcgtgttttaggtttggggtgttaggtggagtttttgttttgtttaaaggtttaggtgtttttgttagtattgtttgtttttgtatttttggttataaggaatgtgggttaaaggtagggtttttgatttttgtttaggagggtgaagtgggttggttttttttgtttttgttttaaggtttttgcggttgtgtttttggaaattgttggttcgagttagtgtgcggagttgggatagattttatcgtggttttcgtggggttattttatgttcgggttggaagggatttttcggtttagttttttttgttttttattaggaaattgagattagagaggttatttgtttggttcggggtggggtgtagatggcgtttgtgatttttgtatgttacgtgtagatagttttttagttgtgggttttttacgtaagtagttatgttggggataatttggttgaaatttgcgatttaatgaagagaagaatgattttttttgtagttttgtgttttataggtttttttttgtttttattttttttgtagaggggttttatgttggtgggtgggtttttgttgttgtaatgggtttaggtagtttttgggtagtggaggtttggttgtttttttgtttaatgttttttgtagtttacgttgttcgggaagggcggggaagtatttagttattggggattttataagatgggtatttgggagatgttgattggtaggttaggttttcgtggtttataggtaggttagaggttatagtgttgagttgggttgagttggtagtttagggtagtgggggtgggggtattttgtttagttatgggtttttttggtataagggtttggagtttattgtaaataatttttttagttttttttttttttataggttattagtagaattgaggggttttttgttgatgaggtgtggtttgggaggggttagttgtttgtttatttgatttttgcggataggtgattataggttttttgttttagggggttgggggaaagatcggggaggtttttttggtttttttatttggaaggaaaatacgggtataggggagatattttatagggatatattttagttagtattttttggttgtgttgggggtatagtgtttgttttgtttataagaggggttagttttttttaggatttaattttagtttttagtgtagggtagatgagtatttagaggtttagaggatttatattacgagagagaagttgtgattatataggtattgaaggttaagtagaagagtgggatatacgggtgatttgaaagttttagggttagtgtggttagttttagatagttggggagttttgggtattaggtttagtaggggaggagggttttcgtgatagtttgttggggttgttgtaataaagttttacgaattttgggggttgaagatggttttagaggttagaagtttaaaattaaggtgtcgattaggttgattttttggggtttttgcgggaggtttcggtttaggttttttttttagtttttggtggttttcgggtgtttttgggtatgtagatgcgttacgttattttttgtttcgtttttatatggttttttttttgtgtttttgtgtttcgtaaggatgtttgttattgtatttagagtttattttaaatttaggatattttttttttgagattttttattgtatttgtaaagattttattttaatttttgttatatttataggttcgagggttagggttttggtatgttttttgggggttattatttagtttattgcggtagttgattttaggggaagtagaatgttttaagtttggggtgagcggagggaacgttgttgggtggggagtgggagattaggttcggagatatcgcggattttttttgtttgatgagggcgtgatgaggtttttattttaggttttttgaatggcggttgtttttgaggagatttttttttttggatttgtttttttagaaatttttatttaggtttaggttttaaggtggatggtaagaggcggttgtttttgttatatttgatgggtgagtgtgtgaacggggttgggagtaggatatttgttatttttgtggatagattttagaggtttatgaatttgttgttggggaaggtgtttgatttagtttgattttttatttttattttttttttttcgtttttttttattagttttgtttttagagttttatttttttaaaggtaggcgtcgttttttggattttttagtagttattttttattttagattttttttttgtaggtttttttggttttagcgtttatttttttttgggtttttgtttttttatcgtgaggtttttgggtagaagtgtggggttttttcgttgtgtttggttttcgcggtatattaggggtttttttaggggttcgttttgttcgttaggtttttagggagttttttaagtttttagatgggtttgatggagttttttaatgcgttgttttagagtaggaggggtttcggttgagttcgagagtttttttagttatattttgggttgtttggggtagttaggtagttcgttttttggaggtgttgtttttttttggttattttttttggaattttttgcgtttagttgcggttttttttatatagtatatttattatttttttttatttgtgatttttttttgttaatttttttatgtttttgagaatggagattaggttttttttattttggagtttagtagaatttaaattaggtagattcgtgtaggtttacgtgggggttttgtggttattgtggttttgtcgttatttttagtttagtttggcgcgttttggattatgttatttagtgtcggttttttaaattttttttttggttttgtaggtttgggaagtagttggtttttgggtgtagttgtgatcggagtttgaattttgttttttggggttatcgttttttgtaattaggttgtagtttatattggttcgggtagaggttatcggttgttcgttttggggttataatatagagagtttcgtgattaatggaggttttatttgggttaagtggtttttggtgttaggcgtttttttttttttttttttttttttgtattttttaagtgtttgtaatattttttttaatggataatgagacgaggagggagggaggggtggtttttttgtttaggtagattaggaatggttatcgtttgtgtgtgtagtgataggtttgggaatagataagggagagtttgttcgggaggttggatttttatatcgatgttgtttgtgtttggtagttttgtttcgggttttagaatagatattgattaatacgttttttagggtttttaggttcgggttttggttttcggtagagttttttatttatgggaagaagtatcgagtagttttgttggtttttcgtagggagttgggatgtatttttaagagtagtatgcgtgaagttcggggtttgggtaaaggagtgtttggggaagagtttgttgttgttggagggtcggaagtagaggggaaggaggggtacgcggtaggttgaggaggtggttggcgattttgtggtggggacgagggggttatgagtagattaggagttagtattacgtttttttgtttttagaatcgaggacggagagttgttagagaggttttggcggggtgtttggggttatttaaagggcgtgggtggattaaagttgaggaaagttttattttgggggatttcgtatttaatttttgaggtttttagagttgtagtttgtggtttttcgaagttaattattttttagggtttcgtttttgtttttagcgatagttatttattagggagtttttgatttaaggagatttgaaaggttatttggttttttttttatttttaggtaggttatatttagatttttttatatagattcgttttatttttttgttgttttttattagggacggagggtgggcggtttttttatttaggttttggcggttttattttagttaggaaattttttttttttatttgttttatatttttttttttgcggttttcgtttatttttttttaatttgtttttagtggagtagttagtagttggtttagaattcgggggtggggggagcgttagattagtgtagtatatttgagagtgtgttagaggtgtttttatttttatagttgatttagtaaagaaaagaggaagtttagtaatttagcgttattttaaagttcgtttggaatgattttgtggttgtcggaattaggggtacgcggtagatgacgggagtaggtatagagaggttttcgtttcggattagtcgttgttgtttttttggaggttgggttgttttttaagaagaggatttaaggttttgtgagcggtggttttttttggagtttttattgtggttttggttttgttttgcgtaaagagagatggtttgaagtagaagttgttacgtggttgttttaggtaggcgttcgtagttttagttattcgggaggcggaggtaggagaatggtatgaattcgggaggcggagtttgtagtgagtagagatggtattattgtatcgtagtttgggcgatagagtaagatttcgttttaaaaaaaaaaaaaaaaaaaaggagtagagaaattttttttagaaggtttgtagttattttttttttatgttttagaggtaaaaaaaaaaaaaattgtatatttcgttttttttttttttttttgagacggagtttcgttttgtcgtttaggttggagtgtagtggcgcgatttcggttcgttgtaagtttcgtttttcgggtttacgttatttttttgttttagtttttcgagtagttgggattataggcgttcgttattacgttcggttaattttttgtgtttttagtagagacggggttttattgtgttagttaggatggtttcgattttttgatttcgtgatttgttcgtttttgttttttaaagtgttgggattataggcgtgagtcgtcgcgttcggttatacgtttttgtttttgaataggtggttttttgattttgggtgtggttattttaagattttgttttggtggggtataattttggttttaggtagggcgatcgtataatttattgttttttgggggatacgttagtgaaagggatttttgaatgattacggtgggataatagatgtgagttgggtttgttttaggaaggttggatgtatgggttttttgagttagaggagataatagtagaaagttttgcggttgatgggatcgagtaggagaagggtcggcggaggttggggtaataacgtatttgtttattgtgaagggtttgtgtgagttgatggttgatgagagggtagtggggcgaggttgttttttgttaggttagattagttttaggatatttatattttttttttagaatcggtgatttagtggttagaaggggttttagaattgacgggatattgagggagtcgaatggaatggttggagtggttatagtaggttttaggttttttttcgttttttttttgtgttttgtttttggggtttatattttggggttgttgtaatagagtgttataatttgggggtttataaatatagttttcggcggtttttggagatttttggcgttttttggtttgtagacgtattattattatttttgatttttggtttttgtttttacgtggttttttttttttgtttgtgtgtttttttttttttttgttttttataaagatgtttattattggatttagggtttattaaatttagaatgattttattttgagatttttattttaattatatttgtaaagattcgttttttaaatgtgattatgttcgtaggttttaggagttaggatttaagatatatcgttttgggggatattgttgaatttattatatttaataaatttagagttggtgttaatgttttttgcggatattatagtagattttggaggttttttgtaaaggaattcgtaggatttttttttttttttggagggatgagattgtagttgggttggggaaagttgttggtttaagttggggttggtttagttggtgttggtttgttaggttgttagagagttttatttagggagaaattaatattataaagttgggggataagagaaggtttggaattttaagggttggttgttgaggttagttgtttatttttttgtgttttattttatagggatttaggtttgttagtgtttcgtttttggaaggaatgttgtgggttgttgtgttttataggtagggtggagggtttttttgtagttagcgagttgttttttttgtagcgtgtagagggaaggaggaggtttgtttattttttttggttttagtcgaaaatttaattataggttttggtattaggtagatttgtttatttttatattattattgtagagtgagttaggttttttgggtggggttgtgatgagtaggaaggattttcggagtgtttgggattttttgggtttagggttgttagaggtagagagaaagaagtttttttttaatatttgagtaaagatagttattagaatttattagagtggttttttgtggtttttttttgggtgttgatttttttggtgtatttgaagtttttagggatattattgacgttttttgtatttttatttaggggttagtggaaatggttttttttttttttgtttagaggtattgtggatgatgattttaggttttagattttagttattgggttacgtgtgtagataagtttgggtagttagtaatttttggttattaagttggttttttgcggattgggtcggtattggaggcgggttttagttgttagtattgtggtttagttaggtttggttttgggaaggtagagggggaggggattgggaaagggattgagttgggggtggggtggtattttggttttttttttttagatttttggtaggtttgaattatttggttgcggttttttaaggagggagcgtttttttcgttttgatgtggattttgttttttgtttacgttgtttttgtttttaaataaatgtggttttttgtggggagtttgggggtcgttttttattgatattgttgttttttggtttttttttgtaggtttcgtttagttttattgcgtttatttttaagtttttttttttggacggttttgttttttgagaatatatttttttttattattttaattgtgtttttttttttattcggagtttgttttatttgttttaggagttattttttttttttattaagtagtttaggttaattttggagggttaatttgtgtttttttagaagtaggttttgagatagggattttagtgggaggggatattaggggatgtttgagtgtgggaatgggttaggtagggaatttagttaataaagggtgttttattagtttattgtgattataggtggttgtttagtttttatatcgggtagtatggggagattgtagatcgtgtttttagttttgttttatttggggttgggtaagggagttggggtttttatattttagtttttggttaaggattgtattgtttattttttttagtttttcgagggtttgggtattaggaaaggttttgggtggagatacggaaataggttatgtgaagttagtgggcgtgattggtagtagtaaggttaggatagttttggttattagtaaggtgattatatattttagtatgtatagtttttatagatatatatttaggagatggtaattatattagtaatagttatttttgtcgcgtgttatgtttgtatttagggaattttattttttatttatttatttatttttatttgagatggagttgcgtttttgttgtttaggatagagtgtaatggtataatttcggtttattataattttcgttttttgggtttaagttattttgttttagtttttcgagtagttgggattataggtatgtattattacgtttgattatttttgtatttttagtagagatggggtttttttattttggttaggttggtttcgaatttttgattttaggtgatttatttattttagttttttaaagtgttaggattataggtatgagttatcgcgtttggttttaggggtattttattattttattattttttatagtaggtgatattgaggatattgaggtttagagtagattgtggttatgttatttttttgtttggtttttttgtttttagttttgaaataaagagtacggtttttgtgtaggtttatacgttttgtttttagttttggagtagtttttaagttttttgaaggtatattaggtttttgggtttcgttttttaagttttggataaataggaggtgaaggagtttttgtaattggattttattttgttagcgttaaggttttgtttgattatttattttattttatatagattagggatttgtgttaaggtttagtgttataggagagtgaagataaggaggtgtttatggcgtatatgttgttggatttattttgtagattttaagggttatggggagttatttgttaggtgaggttttttcgtggtttttttttgtaggtttagggtagtatatagggaggtgtttttttattttttggtattatttgttcggtttttttgagttttgattttggtttttagatagttagtgtttttttagggatagaatttgttttgttgttgtttagaggagatttagtttgattagggttagcgtttttggaatttgagtttggaattttattttgttttgggtagaggttacgttgtttttttttacgagagttgagttgcgtatgagattattttgattttgggttttattatttttttgtatgatatttgttttaggttggagtagggttttgtggttcgtttggtgttttttttttagattgaggtttgatatgtatattaggaagtgtttgatttggttttaggagttgggagcggtttgttaggtagtttgtggttagagtaggggttttaataatggttttttgtgcggtatatttttttttaaataggtttaggtttaggttgtttttgtttcgatttcgttatgggtttggaggggaaagtttgtatttggagggtggtttattgtggtttttttttgtgtagtagttgagatcgtaggtgtttgagaataggagaagttttgtgtttattttgggttgtgagatgtttttttagaggtggggatggggatgggttagtatgtagttatttatattttttagtttgttggtattaaggtttgtgtatgtgtgtgtttttttttttttaattttgtttttttaatatggagttttgttatttgtttaggttggtttcggatttttggtttaagcgattttttagttttaggtttttaaagtgttgggattataggtgtgagttattatgtttagttagtattaaggtgtgttttttaagagtaatattggtcgggtgtagtggtttacgtttgtaatcgtagtattttgggaggtcgaggtaggcggattatgaggttagtagattgagattattttggttaatacggtgaaatcgtgtttttattaaaaatataaaaaaattagttagacgtggtggtcgggtatttgtagttttagttattcgggaggttgaggtaggagaatggcgtgaatttgggaggtggagtttgcggtgagtcgagattgcgttattgtattttagtttgggcgatagagcgagattgttttaaaaaaaaaaaaaaaaaagaataatatcgatggttttattttttgaatatgttaagtgatttttatgtagtataagtattttagaaggtaggaaaatgtaatgaataatatttatcgttatttattttatttagagatcgttattttttgttcgggtgtgagtgtgtgtgtgcgtgtaaattgtatatgtgtgtatgaaatggaattaggatttttgtatatattttgtgttttgttatttttatttaatattttcggtattttttatttttaaaaatgtgattttaatgatggtgtaggtttttgatatatgggtttagaaaatttgcggaaattcggattgtttttaggttttgttagtttaatgttgatgtaaatgttttcgtacgtaaatttttttgtatttttgattatttttttgggataaatttttagaagtgggttaaagtatatgaacggtttttaggtttttggagtaagttgagatcggtggggattggagaagggatttagggaggtttttgggagtttgcgagattggagtttggttttaggggatttgaatttatagatgaaggagatggttggtaaaggtgggaattttttgttttatgggtgggggggtgatattgttttattttttagtgatagtatggggatttttttaatatgatttggtttcgtatttttttgatattgtgtacggtttatagttgtgatgtttagttgggagttttttttgtgttttttagttgtattaattttttgtagatagaggaggaagttgttcggtgtttttttttgttgcgtgggttttttgaatttgtttagttgggtttgtggatttgtgtagttacgtacggggttttaaaatttgtaaaatgataagtttacgaatattttcgtttttgtgggtgaatgtggatattttttggttgcgtttttttttatagggaagatggagacgtgtaaagtgataaggatttgttatttttgggtaggttatgtcggttttattgtgaggatggtggtagggggttttttaggaggtttgtatattgggaagagaggggcgatcgtgtgtgattgtaggatttagggcgtagttttaggattttgatgggggaggagatgttggggagttttgttttgttagtttggtgatagatattttttaatgtttttcggttgggtataatttataatgtttttcgtggggaggtaattgtttatgaggtatttttggtagggatgattttgttttattgttatatattttagtaatgaaataagaatttagagtgatgtgattttttcgatgatttttttaattatttggggtttttgtgcgattttaagaagggggaaggaggtagttttcgtttttttgggtttttgatgtggtagttttggaatggttacgtgttcgttggtttatagtgggttatttgtcgaatgtggttgtggtgggattggggttgggttggagagtgggtgattatattagttagttttattttgggttattgtgtagttaggggttttatttttttaggggtttcgttgtgagtgttttggggttgttggaataaattattggaaattaagtggtttaataaagattgattcgtttatggttttggaggttataagtttgatattaaggtattggtaggattatatttttttcgatagttcgaggggaggatttttttttgttttttttagtttgcgttggtttaggcgttttttggttttggtagtatttgtagtttttgtttttattacgtagttttttttatcgtgtttttttgtgttttaagtttttttttgttttttttttataaggatatcgagtattggatttagagtttattttaaatttaggatagttttatttcgggatttttaattatatttgtaaagattttttttttaaataaggttatattcgtgggtttttggggttaggtattagatatgtttttttgggggttattagttaattttttatagaattttagacgaaagtgaatttttataggttgaaatgggggtgaaggtttagtgcgttttttttttttgggagtttttttagggtttgtgtttattttgtgattttgtgatttagttttttttttgagatgaagttttgttttgtcgtttaggttggagtattgtggtacgatttgggtttattgtaatttttgtttttcgaatttaagtgatttttttgttttagttttttaagtagttgggattataggcgtttatttttatgtttagttaattttttgtgtttttagtagagatagggttttattatgttggttaggttggtttcgaatttttgattttaggtgattcgtttgttttgggtttgttttggttttttaaagtgttgggattataggtatgagttattacgtttggtatttagtaggttttggttgttttttttttttgagatagagttttattttgttatttaggttggagtgtagtggtgtgattatggtttattgtagttttgattttttggttttaagtgatttttttattttagtttttcgagtagttgggattataggtatatgttattatttttggttaatttttgtattgtttagtggagtcggggttttgttatgttgtttaggtttgttttgaatttttgggtttaagcgatttgtttattttggttttttaaagtgttggggttataggcgtgagttattacgtttggtttagtaggttttttagaagcgtttgaggtttggtgaaggtatggtgttatggagtagagaatatttaattttgttttcggggagtcggaatatatttttcgtagttaattttaatagttatgacgtggttaggatgatatggggagggggtggtgtggattgtgtgggaggttagtttttcgggaagggggttggagtgggtttggttttgaggaggatttttaagaggaggaggaggcggtggtatgttcgtttggggggatggcgtgagttagggtgggtatttttttatttaggtgttatttttttgatattttagtcgggatatggtttttttggggaagatggatatttttagagtggggtattttttggggaagatggatattttcggaatggggcgttttttgtttttattgtttttttagtatatagttgtatttttttgtagttttggaggttgtgagattttttggttgttatttagaataaattcgtttttgagtagcgtcgttttgatggtggggtggtttttgcgggtggaatagtttttgttgttttagagtttattgagagttagtgggtatgggagtggtgttggatcgaaatatttagagggattatagagttaggtagtaagtatagaggttagttagtggggagggagggatttatttatgaaaagatattaagtattgaaagagaggagaggatggttggggatcggtatatatgtgtattttgcgtagatggttaaggtggtgaggcgttagttacgtagataattggaggaaggaggagtgttttaggggaggggttagtttcggttttagaatgattcgtttgtgtacgtgggtttggttggaataaattattgtattcgtatcgtagatttaatcgtaagtttatattagggtagtttttgttttggtgtagtgttttcgattatgagttggttatggtgggggtgattttaaggggatttttaaggagggggtttatcggattttttagggaaggttatttgtttttttgggttggatttgggataaggtttttttttgtttagtttttgttttttaatttgatcgtacggaaggatgttgaggatatttggaagtcggtttttgttttatagtatttataggatagaggtatattatgtggggatagtttggatagtgtttaggaggtagggagtagattagaggatcgcgggaggttttgggaatcgtacgaggatttaggtattgagttttgtattttttggtattagttcgatgtatagtttggttttgtgtttatttcgtattttattttttttatttgtacgggggcggtaataatattttttatagtttaggtttaagcgggtgtagatgtgatgagtttggtaagtttattttattatatttagttttgggtattgaattttggattttttggttggtagaagtggatatttaatttttttttggggttttggggtttttgtagaattagaatatagttagtagtttgtatgtagggtgtagagggatagagggatattatgtcgggagtttatatttggtatatttttgattttggggtttagtgttttgttgttttgcggttacgtgattagttagaggttatggttggatttataggcgaatatagtttgtggatttgattttgtttggttttgcggtgttttattttatttttagttttagtttgtggagatagagtttcgttttgttagttaggttgagtgtagtgatacgattttagttttgtaatttttgtttttcgggtttaagcgatttttttgttttagttttttgagtagttgggattataggcgagtgttattatgtttagttaattttttatttttagtaaagatggggttttattatattagttaggttgtttagtgttttaaaaagggtttgttttgttttgtgttagtatttaaagattaggagatattatataaagatttagatttttatttttttgagaagtgaatagttttggttacgtcgggtttatattttttagggtagtgacggagttgagatagggtttgtgataattgagagttttttggagtttatacggttttttgtttagtttttggtggaggttgagtttagtgatttaggatttcgtttgtgtttattaagaaggagaggtgtttgtggtttagagagggcgtttataggagtgttttgtttaggaagttggtagttgaggcggttagggttagggggttgggttttttttttttttttttagtgtttgagtgtatttggaggaagagagacgggtgaggggaaggtattgaaattggttttggagcgttattattgggggttggggattagttgttatttttttttttgtgggtaggggaggtagtggtgggattttatgagattcggattttgtggtttggtgaggtagggagcggttggggagatattgtgggtttttataggggtgcgttgtgggtttggtttggggaaggagttggtgaatgtgtttgttatgtgggtttttttttgttttggttttgataattaggagcggttggtttttatttggagtgcggttgtggggattgtggaggtggtagttttttaggtattatttttattgttttcgagggagtagattttggtggagaggtaggatggttgtagggcgggagttggtggttggtattattgtacgggtttgtagtagtggatgggaagatgtaggagaggttgatgattgagaaagttggtttttgtggattaagttgggggagtcggataattaagtggttagaattttgggttttggtattagtttgatgtatagtttggttttgtgtttatttcgtgttttattttttttatttgtattgggggtattggtattttttatattttagggttaagcggttgtagatgtgatgagttcggtaggttcggcgtttcgtcggtattgaaagttttagtgttcgtttttagtgttattgatggggttttgtttttgttgcggttttgattggttatagttgcggttatttattattggaggtatgtttttcgttgtggttgatggtagaggtgtgtttgttggtggtgttttagtgtgtgttttggttggaggtgaggagggataaaaatagtcgcgataagaaggaaattaaggtcgggtacggtggcgtacgtttgtaattttagtattttgggaggtcgaggcgggtggatcgtttgaggttaggagttcgagattagattgattaatatggtgaaattttatttttattaaaaatataaaaattagttaggtatggtggttcgtgtttataattttagttattggggaggttgaggtaggagaatcgtttgaattcgggaggtgtcgttgtattttagttagggtaatagagtaagattttattttaaaaaaaaaaagaaggaaataaaagttttttttggaattagaacgtttttatgtagacgtagttggagggggaggttgtgtggtttgcgtcgtggttatggtaagatacgacgggtagtatttttttattttagtttgtatttttgttttagaatttatgatggtttttttaggatggggttgtttttttcgtttgttgagatatgaaggacgggaagagattttcggtttttatcgtcgtatcgtttgtttttttttgttgttttttagtaggaaatatgtcggagtgttttttagttatttatttattaattgtattttttttttttattttttagttttgaaaagattttttgaggtcgaggaggtcgagatatttaattttattttatttcggagggtttagatttttttatttcgagttattgtggttagttttatttagaaattttaggatttgggcgtgaagaatttagaattttcggttcgttatgtggattttttaagttaacgtttttttaaggcgtttttgcggagggtggagttttcgggttttaaggcggtcgagtcggtgtttcggcgtattgagttgtttattgatatttcgtttaagtaggtggagaacgtcggggttatcggttcgtttcggttcgggtttaagagggtcgaggtgttgggttataagacgttagaatcggtttttcggaggacggagattattatcgttaaattttaggagttagtttatcggaggatggagttttttgtttttaaggttttcgaggtgtttattgtttttgttatcgacgtagtttttaagagggtggagatttagatgtttaagtttgttgaggcgtttatcgtttttagtttagtttagattttggagaatttagagtttgtttttgtgttttagttgtagagtaggttggagtttaagttttagttttttgtggttgaggttatatttcggagttaggagggtgagtcgtagagcgttaggttttggatgttgtggtaatggggggtttggttgttggttttgttatagaattttggaggaagaagttggatatggggtggagggtgttattttggagatttagaaagatcggaatgtatgggggtgggggtttgtaagtttaggagaggtggttttttttgtttgatgggaatatgttaagatgttttaagcgggatttgaatgagagtttggaaagattttttgggttttaaggagttttttttatgggttatcgtgggttttgttgggatttttgtttgttgtgtgtttttggagggtttgggaggtttagagaatgaggagttacgtaggaattagggtaggtttatgtaggggtgtaggatagggtggagttgagatttttagaagggttgttatattttggtggtttttgtttgaggaattgtaggttgtttggatatgtttagtagaggtcgagggtttggggaagggaggagggacgtatgttttttgaggtttgtattggagtttatggtttggttttttttttttaggagggatggttgtggtagagggaggggaatatgaggagtattttagtttgtaggataaaatttttagggtattgggaaggggtgtttggattagggggttgtgtgatagttgtatacggttttatttgggggtgtttttttggcgagaggagagaggttatggggttttagtagcgttttgggagggtttaagtttatagtcgtgttgatatggagtttataggtaggggattggtgttagttttgtgggatatagggtttgtttggaaatgttaggttgtgggatatggttgggtttttttttagaagcgtgttttttggttttagtagggatcgtggttttatggggttatagtaaggtgttagttgggttagaagttttttaagagttaggtttgattttgggtataggattagaatttagtaatgtttagtaagttttttttaggttggataaatagtatagtttgggtttttgatttagttgttgttttttatttttaatcgtggtgaaatatataatatataatgtgtaattttagttattttgtagtgtacgttttagcggtatttagtatatttacggtgttgcgtagttgttatcgttgtttattttcggtattttttttatttttttaaattgagtttcgttttcgttagattaagttttttatgttttttttttagttgttggtagttattattttattttttgtttttattatgaatttatttgattattttaggaattttgtgtgtgtggaaaaatataataattgtttattttgtgtttggtttattttatttagtatgacgttttaaaggtttattcgtcgtgttgtagtatggggtagaatttttttttttttagaggttgaataatattttgttgtgcgatgtatttgtgttgtgtagttgtttttttatcggtggatttttgggttgtttttatatttttttaagtttttttttttattttttttgatttttttttgatttttttgagatagggttttgttttgttttttaggttggcgtgtagtggtgtgattattgtttattgtaatttttgttttttgggtttaagtgattttttagttttagttttttaagtatttaggattataggttgcgcgttattatgtttggttaatttttaaattttttttgtagagataggtttttattaggttgtttaggttggttttaaatttttgggtttaaatgagttttttgtttcggttttttaaagtgttgggattataggtatgagttatttaatttttttttggtttttttttttgaatgagagttttttagtggttagtgggtttgggggttgggaggatgtggggtttggagagggtgtgggtttggggggagattagtgttttttatgtttttatgggtatgtggagtgtatatttgttttggcgggtttggggtttgggattttgtattttttatagagggggtatcggaatatattgagtagttagaggttagtgggttttggaaggtttttttcggtttttagtgtgcgagtttcgtgtttttttttttatttttttaagtttgattttgaagagttattttgttttagttatttagatttagtgatagtggttgttggtggtatggtgttaggttaaaggtatgggtagtttgtagagtggtaggaggttgtttttttttttgttttttgttggtgtaggatttttgtttgacgtgtcggatatatttttattttgggttgatgtgtttatatttagttgagttaaataggatgtggttggggaggcggttgttatcgagttatttaaatttcggtgatggttggtgttggatgtatagggacgtggttttggttttgggggataggtagggggatgtttatggggatgtataagaatatttttttttaggggtagatatagtttagtttttaaattgtgttagagattgtgtcgggagttaggtttagggatataatttgcgggttttgttttttggagtttatcgagtcgtgagtaggatggttgggatataaggagtgtttagggagtttttttagtagtggaagtataattttattaggttaggaaggggagagaaaggtaggttacgtggaggtagtagcgtttagagttgttaggaatttggcgttttggggggacggtggttttttttatggaataggatgtatacgttggagtcggggtatgggagaaaattattagtattttagattcggttatttacggatagggatttgtgtaggtgggagtttagtttacgtggagaggttcgtgggttgggttgatagttttgagggtttaagtaagtttaggtggaggaaatgtagggatagacgagggtagggtttttttaatggaggagtgtttttgaaattcgatgggagtggtttttcggggggtttaggtttgagttttattagtttttttttcgaggtattatttgtttgttttttcgttttttttttttgtgttacgatcgttttggatacggatttagttttttttaatttagttttttgtttattttttttttaggtttatttttttttgtttttttatgtggggttgggttgggagttttttgagtttcgatatgtatagttttgattaatttttgcggtttttttgtttttcgagtattagggatttagttggtattatggggaaaggaattatggagggagtttcgtgttttttgagtagacgtttagttttttggtttttgtttgcgggagggtatttgtgttgtggtttgtttttattttagagttgtgggtgtagggtagggttttttggggttttagttgaattgtttttagattgatttttttaaagtatagtattgttgagattttttttcgtgttgagttttttttgtttatttattataggtttttttacggttgatttatttttttgtttagtttatattttttttttttttagttttttttgttttggtttttttttggttttttatatttttttttataatttttttgttttgattttttgaattttgatttttgtttttttttatattattgttttggtgaatttttatgtattttttaaaatttggtttaaatatttcgtgtttggtttgggatataaatgatttgtgtataaatttttttttttttgttagatttttttttttaaatgtgaaagtagttttttagattataaaaagtaatcgagtattttttttttaaaatgtaggaagtatagaaatgagaaagaatttaaaatttatttgtaagttagcgatatttatgtttgaggttttgttgtatagtttttaaaattttttttatgtttttattagattttgagggtagggttgttgtttttgtttttttttgtgttttttttttgttttttgttttttgagatggagtttttttttattatttaggttggagtgtagtggtatgattttagtttattgtaatttttgttttttaggtttaagcgatttttttgttttagtttttcgagtagttgggattataggcgtgggttattacgtttggttaatttttgtatttttagtagagacggggttttattatataggttaggttggtttcgaatttttgatttcgtgatttatttattttagtttttttgattttttaaagtgttgggattatgttatcgtgtttagtttgttttggtttttataaagaattttataaggggttaggtgtagtggtttatgtttgtaaatttagtattttggaggtcgaagtaggtagattgtttgagtttaggagtttgggattagtttgggtaatatagagaaattttatttttataaaaaatataaaaaattagttaggtatgatagtatgcgtttgtagttttagttattggggaggttgaggtgggaggattatttaagtatgggaggttgaggttgcggtgagttgagattgtgttattgtattttagtttaggagatagagtgagattttgttttaaaaaaaaaaaaaaaaaaaaaaaaaattttataagatattaagtaagtgatttggatataataggtgtgttatgaaattatgttgaaggagtgagttattggtggtgagttgggatggtttttttgtggtttttgtaggtagatgtagtgatttttatgggtcgtttttagagattaagtagaaatttttttggttaattttatttttaggatatttggttttttttttggaggttgtgttggagggtttagtgggtgggtgttggttttagtgtgggggttttggaaggagttagtattttaggagggagtgtgggtatttagatggttgaaggggagggagaggaagagaggcgttgtagagggtagaggtatttttgtttgttttttcgttttagggtttggtgaggtttgagttttatgttggtggggtggattttcggttttcgaggttttggttttgtttttggatttggtattttttttgttgtttttttatagaagggcgtttattttttggggttatttttggtttttttaggttttgggtggggacggttttgtttttttttttggatttttgttttttttttgttttttaatatgggtgtttttgggtggagtggggtggggttgggttgtagtatttagtattgagtttgtaagggttggttgttggtttagagttttttttattagagttattttttttcggttttttagttatattagttaagtttttttagagttgttttataaggcgggtgtttagcgttcgtttatgggtttggttttttgtttttttgggatgtttattgggggtaagagggaggttaggtttagtgtttagtttagttttgggtatgttttagttttgttttatgagttaattggttttgaattattattttattttttttagttttaattttttgatttgttaaagaggtatttgtagaggtggttgggggttgagtttttatgtatttatttattttaagaattaagaagggagtttatagtggttttggggttatttgtgaatatggatgtgaaattggggcggggtagatatggtagtatgttttagtagtttttttgtgatttagagggtttggaaatttttgttatgtgggtggagcgttgagggagtagggggttaggttttttcgagttgatgatggtgggcgtggtttttcgtatatttggttcgtatcgggtcgtgtgttttaggggtagaatagggaggaattttagtatagatagtagggttgttagtatagcgttgagtatagggttaattaaagtatagggttttttggaattatttaatatagagtagtgaagaggtggttttggggaaagtggggttagagttgagtttgagtggggggtggggagggcgggtattagtttgtaagggagggatatttattgggttttagaagtttttggtggggattagggattgtgaagttggggagagggtgattattgtgatttagggaggaagggttttatagatagtttagtttttggtttcgtgtttataggatattttatataggttttgagtttatttttggattgtggattttttgaggtagggtgtgtaggttcgtttagtattaggtgtaaggtagggggttttggtaagcgtcgagggatttattggtgtttgatgaagtagtgagtttggatcgtgttatgtttcgggttttgagtttgtaggatttttttgtggggttgtgtgtttttgtttttggaggtgtttagaaggtattgacgtttttgtcgggatgttttattcggaaggtttcgttgtttttatttttttttatttttttgagttgtttgtagagggtatttaggtttttttttattttgggattgggtttttttttttttttttttttaagaataagtatttttttttttcgaattgtttttggagttttttagatttaggtttagagtgggaagtttcgtatgtgttgggggaataggaattaatgcgggaggattggttaggttcggtgtgtttttttcgtggtgggacggggtggggttagagaatagagtttggttttagagtttaggaagagaattttttttttcgtcggtttgttaagtatcgtgtagtggtgagaggaaaggagggttggttcgggaatgtagcgggtgtcgagtagttgtggaatattttaaatagagcgtagttgcggggaagggtggggttaggaggtaggcgttgggggcggtttttttgtttcgttttttgtagttttgtggttttgattatttagtttggttttaggatggagtttcggtttttagatatatggtattgggtgaggtcgttttttagtatttgttttaggaagttagagtagttgttagaagagagaggagttgtgtttgtattcgtcgttttttaggttcgggatagttgtcgggattgagggtttgtataatggcgagtttgttcggaggggcgcgtcgcggttagatagttatgttttgtgcggtgtggatagagggtatatttagttttggaggagcgtatttagatttttcgtttcggggtttaaagtgtgggtagtttttaattagattttggattttagtagatagtttgggaggatgttatgtggtttattttgatatattgttttatttgtgattttatttttgagagttgtagggaggcgtttttttagttggattttatttttttttcggggttttttgtgggtgttataagtgattttgttttttttagtttaaggggggtttttggggtatgggttgtaattgataggttagagtagtttatggttagggttgagtttttttttcgttttttttgaatattgggtttaggaaggggttaaagtggagatgttttgattaaagttgagggaggtatggagtttttttgattttgtttttttattttattgttgttattgggtgtattttgtggagttttaggatttttaaagaatttagagtggagattttcggttttatttagtgtaggtgagggggaaagtgatttgtttatagttatatggttattattagtatatttgggttaagttcgattttattttacggtttttgtttgaaatttggaattggaaatggttttggaaattattgattttatttgtcgttttttaaaatggttcgtagaggttaagatatagatttttgtaatgttttgtttattcgtgtgtggggaaatggtagaggagtatcggttttgtttttatattgtttgggttgtcgtttttgttttgtttagtggtttttttttttggttcgtttttttattgtggaagtgggtataattttttttgtgtagcgtggttagagtggatagtgatgattcgtgaagtagggtggagcgtttgggggattcgtgttaaataagtatataaataaaagttaatataatttttatttaattagtaagtaggttttgtttgaagtttttgggtagtattttatgttatttttaggttttaggtcggtggtgtcgtttcgtgttttttttattcgtaagttggtgtttagaagttttgttttgtgttttggtttttattttttttgtgatttttttttttttttattttaaaaagtaatgtacgacggggcgtggtggcgggtatttgtagttttagttgtttgggaggttgaggtaggagaattatttgaatttaggaggcggaggttgtagtgagttgagattgtgttagtgtagtttagtttgggtaatagaataagatttttatttgggaaaaaaaaaaaaaagcgatgtttagttatttttagatagaaaatgaagattatatgaaatttggaaagaagttttttttttttattttttaatttttttttaaggggtggttatgttgatagttgggtgtggtatttttttgaattttatttttgtagagttatttagggtttgtgtaaaaaaagttaatgtgtaaatatagattttttaagaatataaaggaaattagatttttgttattagtttttattttttttatttaataatattgttgttatttgtagatgtagtacgtttttttttttttttttttttttttttttttgatagagcgtggtttaggttggagtgtagtggtgcgattttagtttattgtggtttattgtaatttttatttttcgtttttcgtttttaagcgatttttttgttttagttttttaagtagttgaaattataggtgtttgttattatatttggttaatttttgtatttttagtagagacggggttttattatgttggttaggttgtttttgaatttttgattttgagattcgtttatttcggttttttaaagtagtacgttttttttaatggttgtgttattagttgttttatggttttgttaggtttgtttagttttttattgtgattgagaggttgtaatagatgttttcgtatttgtatatgtgtatatatgattgaaggatgagtttttagtgaatttttgtgttaaggatgtgtgtatttaagttttgatttgttgggtatagtggtttatatttgtaattttagtattttgggaggttaaggcgggttgattatttgaggttaggagtttaagattagtttggttaatatggtgaaattttatttttattaaaaatataaaaattagttgggtatggtggtttgtgtttgtagttttagttatttaggaggttaaggtaggagatttgtttgaatttagtaggtagaggttgtagtgagttaagatcgtgttattgtattttagtttgggtgatagagcgagattttttattaaaaaaaaaaaaaaaaaaaaaaaattgatttttgtttttgaattggtttttaaagtggttattagaattttttaggattttttttttcgtcgatttgtttagttgtttgttgggttttgtgtagtgatggtttagtagggaggttttatgttttttatttttggttgagggttaaatgttttttaattggtgttttattttgtgtatttcggttaagcgagagggattattttttcgtatgttataggttagggttttgtgttttttttttatttggaaggtgtattttttttttgttgaaattttttaaaaagagttttttgtaagttaggcgtgatggttaatatttataattttagtattttgggaggttgaagtgggcggattgtttgagtttaggagttcgagattagtttaggtaatatggtaaaatcgtatttttgtaaaaattagttgggtgaggtggtgcgtttgtagtttcggttattcgggaggttgatgtgggaggattatttgagtttgggagtttgaggttgttgtgagttgtggttatattattgtattttagtttgggtgatagagtgagattttgtttaaaaaaaaaaaagagttatttgtatatttttattatagtaggtacgagtattttgtttttagttgtttatttttgattttgtttttgggatgtttttttatatagaatattttaattttgatattgttaagtttttgtttttttttttagtttttggaatttatattttgtttagaggttttttgcgttttgaaattataggaaagaattttatttacgtttttttttagtatttttgtggttttatttttatatgttgaaattatgaatttattggaatgtattttggttttagtagcgaggtaggggtagatggtattgtttggatatatagtagcgagtttggtttggagcgggtggggcgtgtgtgtgtgtgtgtgtgtgtgtgtgtgtgtgtgttatttttattagttttggtgtttgtattgtgttggtttagtaaaaataatttggatgtattttttttattttttgttttttggaatattttaagtagtaatataataatttttttgttaaaattttttaagaatttattcgtgaaattatttgagtttgatatttttgggggagtttagtattttaaaaatttaaattttttttatgggtttgtgagtttgggagtttttttttttttttaaaatttattattattttttttttagaaaagtgttttttagtttatttaaaattcgttagtttatttcgagggggttgttttagttcgtttagtgaggatagtgtgtagcgcggtgattgatatgattgattagtagagtacgatcgattagtcggtgtgtaaatatgattgattgtggttagcgttttgggatgttttatgttgaggtatatgtgtgtagtgtagggtgatgtgtattttgagaggggatgaagttataggatttttgtatttttaggagagagtttttttttttaaggttgtagttttgagtaggtagtgacgggattgggtttagggggttgagtggttttagtaggttaagggttttaggaattatgagaagtttggagttgtttagagagtagtttttaaaattagtttggattgtagtttttagaaagatatgcgattgatattacgaattaggatatatttatatatggggtgggggtggggatgggatgtattaatgaaattaaattttcgtgatggaatttttatttttattatgcgtgtgttatatttagtatttttttttttttttttttttttttttttttttttttttttttttgtttgtttgttttggagagagggaaggtttttttttatttttttttaaatagttttattgagatttaagtaagttattatataatttattaatttatttatttatttatttttttgagacggagttttatttttgtcgtttaggttggagtgtagtggcgttatttcggttgattgtaattttcgttttttgggtttaattaatttttttgttttagtttttcgagtagttgagattatagatatgtattattacgttcggttaattttgtatttttagtagagacggggtttttttatgttgaggttggtttcgaatttttgattttaggtgatttattcgttttagttttttaaagtgttgggattataggtatgagttatcgcgtggtttaatttatttatttaaagtgtataattttatggtttttagtttatttagagagtagtgtaattatcgttattataattaattttagaaaattgaaaatttgagaaatttagaaaattttttttttaagaagaaatttcgtagtttttagttattaattttgttttttttttttatattttttttttatttgtgtggattttttttttttttttttttttttttgagatagggttttattttgttatttaggttggggtgtaatggtttaatttttgtttattgtaatttttattttttaggtttaagttatttttttattatggtttttcgagtagttgagattataggtttgtgttattatgttcggttaatttttgtattttttgtagagatggggttttattatgttgtttaggttggttttgaatttttgggtttaaatgatttttttgttttggttttttaaagttttggaattataggcgtgagttattgcgtttggtcgattttagatattttttgtatagagaattgtacgtttggtttttgtgtttggtttttttatttggtgttatgtttttaaggtttatttatattgtggtaggtgttagtgcgtttttgagtaatattttattatggtatggattattttattgtggatagatatgttgtttttattagttgagggatattgggttgttgttatcgttggtgagtgtattttttttaaattaaaaaaaaaatgttggttattatttattagatcgtttttttggtttatagggtgggataagtcggtttgggtgagggttaggaggtggttaggtggaggcggttggagcggttttgggttgtttttgggcgtagtaggtagaggtgtaatggtagagtttgagtaggttttttgggcggatttttatgtcggtaatgtttgtttatttaagaagtttcggttaggcgtggtgttttatatttgtaattttagtattttgggaagttgaggtaggtagattatttgaggttaggagttcgagattagtttggttaatatggtaaaatttcgtttttattaaaaatataaaaattagttgggtgtggtggcgtgtatttgtagttttagttattcggtaggttgaggtaggagaatttgtttgattttaggaggtagagtttgaatttaggaggtggaggttgtagtgagttaaaattgcgttattgtattttagtttgggtgatagagtgagattatgttttaaaaaaaaaaaaaaaaagaaaaaaaaagaaatttttagtgttgttttgtgttcggtatcgaagtcgagggaaggtagtattagtatgagtttttagtttatcgggtttttgtttggagttgacgtgcgattaaggtatacgagggaagtatggcgaggtggacggtgcggaggtataaggagtaaaataaggtagatgtagtggtttagtggtttttggtggttgcgaggagcgtgggtaggatagttttaggagggtatttggagagtagggtcggttggggtaaggtgtgttaggtatttgttaggagtaaaatgtaaggggatattaaagagtttaggaattaatatagatagtatttaatgtagtattttttaatatcgaaatgatgtatagtaatttttatgatgaataaatgttggaattttaaattaagataggtttagttttgtacgtgtatagttttgttagagtttgtttagcgtggaatttgatttgtttaaaatgttgttttaaaatattgtttgatttttggattttttggtattgttttaatttttgtatttggacgaaggttttattttaattttagttggagagggttaagggttggtgaatttggttttggatttgtagagtttgtggtatttgagaggtggggttaggaataggaaggagttggtgagaacggtattcggtatgggatggggttagattagagtagtattgtggttttttttaattcgtggttttgttgttggatgtttggcgttggtgttgagttttcggttttttgaacggagtgtgatgaataacggggtcggggagtttttgggtttttttttgaagtagtagtgaagttagggatatgtcggtagtaggtagggagagggacgtttggtttgtgtttggagttagttgttttatggaggagttgggtgaggatgcggtgggaggaagatttttttagttttgtatttttcgaagtataattgagtgtttgtgtggtttgggggttattttggttcgaggatagttttgttttgtttagttaggttttgaagagttatcgggatacggatagtagttttgttgggtggtaggttgtttattttcgtttatttaacgttggaattggatgtagagtatttggatggttagttttagagtgtttttgatatttttagttattttattttttagattaggataagatgcgggattttaatttcgagttttttatgggttttattttatgtgtttttataagttattgggtttattttttggttttagggttgtttggttatttggtattttggtttttttatttgtataatgaaaataatagttttagttttttcgaggagttataagatgtttttcgtgtgaaaaattgggatttggtattagattatttggatttgaattttggttttattttttttaatttgtggttttgggttaatttggtttttttgtttttagtttttttatttatagagttattttattgagttgttgggaggatgaatataaggaagtgtatttatgtgtttagagtattgtgattttatttattattattaaacgaggtatataataagtgtttaatagatgtttagtgttattttacggattttgtgtgttttgtgtgtttttagtagttaagttttggaggtggggaagttgttgacgagttgtacgaggtaattagaaagaggaggttataggtgtaagggtttgggtgatatttgtggatagagagaggtcgatggattttggtagaggggaagggggtttttgtatatagaaaatgttttttgtatttaagatttttgtgattttggaatagaggtagtagaggtttgtaaattttaaattataaatttagaaagtatagaatattcgtagagaggattagaaatattatatattttagtgtgtatagaattttttatatagttaaataaaagtacgtttttaattgaagttgttggagagtttttgaggattttatattagataagggtcggtaagtggaagtttaatacgtaggagttattttttttgtttataaatgtttgtcgttttttttgtttatattcgtatttatgtgagggtatttataggtttatcgtttagttttatgttttgtttgttattaaaaaattttttaagaattttttagttgtaaatttttttatcggagggggggttttaggaatttagttttgttcggggttggggtattttagtatttgttgtataggcgttggttattaaaggttatgtgtcgtattcgtgggttttcggggtttggtggtatttgggtatatagtttagtggcggttttttatttgttagatattgggagtggggggttttttatttttgttttttggcggtggggggagtgtttcgagttgttatatattagaatttatcgatttatacgttgcggtattttatagttttttgatagttttttagtttgagagattattaaattgagtttttggagagggtggttgttgaggtttggatataggtgtggataggatagttttgttttatttcggagtttcgtttcggtttagttttttgtgggtttgaagtttaggttgggttagtttttgttttttagatggtcggaaaggtagtttagttttacggtttttttgttaggttttgagagtcgtttggtttttagttttgtttttttttttttttaagatggagttttattttgttgtttaggttggagtgtagtggtgttattttggtttattgtaatttttattttttgggtttaagtaatttttttgttttagttttttgagtagttgggattataggcgcgtgttattatggtaggttagtttttgtatttttagtagggatcggtttttattatgttggttaggttggttttgaatttttgattttaagtgatttgtttatttcggttttttaaagtgttgggattataggtgtgagtcgttacgtttagtttttagttttgttttgatttttttttaaggtcgtgaggatgtttacgtttttttttttttttacggtttattgatgtttttagatgttttgtaaagttatttttttttcgggagttttttagttggtgacgggggattttttggggattattgtttaggtagttatgtaggtttgtgggtcgtgtttttaggttggatcgagattcggtgtatggggtgtttttggtttgagttgaggtttttggaagttatagttaggaggtagtaagggacggttgttatgtttttttttttttgttttttagggtttttgcgggatagatttttttgtttgagttttttggttgtttatattttggttttttaaagtttagtttgaagttttaggtattttataatttgttttttttagtagtttgttttgttttttttttgtcgatgtttttgaaatttttttgtttttttttattttttggttagagagagattggagattttgtgggaattttcgaggggagggagaaggtcgttgtttgaacggaggtggtttttttttttgtttttttttaggcgggttatatttgtaggtttagttttttgttgtggtagcgtttggggtgtcggttgttttttgggtacgagttgggagttgagggaggcgtttttaggatcggagtggtaatttagttggaggaggagtaataggttcgtggttagtagtagtcgtcgtagggatttcggcgttgtatttgtgttttagttgatttttttcgtttttttagggtgggtcggggatggtggtttgttgtttagtttaggaagaagaggggtcgtaattagtagtagttattttaggggattttagcgttgtatttgcgatttagttgattttttttttttttttagggttggttgggaatggtggtttgttgtttagtttaggaggaagaggggttgtggtttttattttagaggtttttttttcggtttttttttcggtgttggtttaattgtaggtttgttttaggtcgtgtcggtatttgttgattgacgtttagcggatgttgataggagagggttgggatggggaagtagtaagtttcggttattgtgggttcgggttatagatggttgaggtattttttggttatttttaggaagtaaggttttacgtagttttcgatttatttattgttcgtgtgtattttaggaggttgtattttttaaggtttttattaggtaattttattgggttgggtgtcgttgtaaaattatttattgggtgcggtggttttttggtggggggtatggttggggaggatgcggtggaggagaagttagtttcgtggttggggggagggcggattattcgttttttgtttgttttttgaattggagtttatggttttttttttaggtgtttgggttatggaagaggttatagttttgttttatttttgtggtagtttaggggagttttggttagtttcgtgttttttgggagggcgatagtttggttaggttgtagggtaggattggaatgtagatttttgtttggttatgttgttgtttggttgttttgtttggggattttttgtttaggaagagagaagcgggtcggatagttcggtttagtgattggaagtttagttttttatgtttagtttagtaggaagtttgttttttcggaatatttgcgtgtttttgtatgtgtttttttggttggtggttttgcgaggtttttattgggttgcgttatgttttttggttattttggttttggtgtttggtttttgtgaaatagagatatttgggtagttttttatttgtgtttgtaagtttgtgtggttttagtgatggttgattttgttttatttagaggatttgggaatttttagtttaattgtttagaggagttttttttagtggggagagtttgagttgtttttttggtggatagttttttagattttaggcggatttttttgtcggtcgttttttttgttgtttttgtttttttgttttttatttgttttttatttttttttttgtagtagttagttggtacggggatttttttttttttttgggattgtgaatgagacgatttttttggtttttttgggtttagatttttttggtaatagttagtgaaatttttgttttaggtgggaggagaaggtttagtatgtggttataataacggttttaattatattatttttaaacgttggtttttatttattttttgttttgtttaatagttatttttattattttattttttagattaggaaattaaggcgtagagagttttagttatttgtttgaggtttttatagttaagtgtttggatttgaattttggagtagtttggttgttgagttgttttggagacggggtattgtgtagtggtcggggtaggggtggagttttgtcgtcgttgattttcgggttatttggagtgataatatagtttagtgtttgggtttttgtttgagattttggttggatgttaggagttcgagattttttagtttttttttgtgtaaggcgttatggggtgaaatgaaagaaaattttagttagaaggtgtttttttttttttttagttttttagttgttttggattttgaaataagatatcgttcgtttgtggggtgagtaggaatagattggaatcgtatttttttttttttagttatagttgttaggagtttatttttttttgttttttttttttgtcgtttttttttataagattgggttggatgttgttgggaaagttaataggaagttttttggttgcggtggaggtgggggtttgtgtttttttggggatcgagatgagggttttaggttggtttcggtaagagtagggaggtttacgtttttgtttgttggttttgttttttgttttgggagaaggtatttatatgttttagaatgtattttttgcgtgtatagggatggtttttgggttatttatttgaggtttattgatttttttttttggaattggagtggtttttttacggtggattgggttgagttttttgtttcggtcgacgtttttttttaggtatttttttttatcgtgttagggtgtaggttgttagtggatgggtttttattttcggggattggtagttgttacgtttattttatagtcgagatattttggtcgaaggttttgttaagttttatggagtgtagggattttttttgagacggtttttttttgtcgtttaggttggagtttaatggtttaatgtttcgtttattgtgatttcgattttttaggtttagtagtttttttattttagtttattaagtagttgggattataggtgtgtgttattatgtttggttaattttttaattttaatttttttttgtagaaatggagttttattatattttttaggttgaattttaatttttgggtttaaatgatttttttgttttggtttgttaaagtgttgggattttaggtatgagttattgtgtttagttggggtttttttttaattttttttggttttttttaggtgtaggattcgggttttagttttatgtgtttttgaatagttttgggttttgttttgtattttttgggcgcgtggttaggtttttcgtgatattagtaggagatttaggtgaagaagtaggtagaacggaatgtttgtttatttagtttcggggttaggcggggcggttaggatagtagtagtggttggtgtggttttttgggaggttagtttattggcgtggttagcgaatggggaggggagtttttttttttgtttttttttatttttggtttttgggtttttagggttaggtttttagagttttaggtggaggatggaggttagggaagttggggtaagagcgggttgggggtgggtggttaggcggattttggaaaattattttttgtaggtttcgttttttttagggagtatttagggttggtttcggggagtcgggttaatggttatttcggatggtgtaggggtttatttttatgaaatcgggtttatttttatgaaattgggtttatagaagtttttggtttcggttttgttttgttttttggtttttgtttttaaagtaggatttaggatagttttgaattttttgtcgaaatgtagttttttgggttttaatttagttttttagaattagagtttttggggtgggttttttgtttgtttagtagtttttaggggatatttgtgtttgttagagtaagtttaataagtattgttgtaaatttttcgtttttatagttttttggttcgtttttttttttttgttgggatttgtattaggattaaatgttaatattagggattaggttatatttgtgaattttgagataatatttgtattttttttttttttgaggttgttttgttcgttttgttatttaggttgaagtataatggtgtgatatttatttatggtaatttttatttttagggtttaagtaatttttttgttttagttttttgagtagttgggattataggtttatattattatatttggttaatttttgtatttttagtagagatggagttttattatgttggttaggttggtttcgaatttttggttttaagcgattcgttcgttttagttttttaaagtgttgggattataggcgtgagttattgcgttcggtttgatatttatattttgattaagttgttgtggaaatattgagttttttttgatagttttgtttatagagtgaatgtttaggaatcggcgaggtattttttatttttatttagatggcggtttggaggtagcgtttttgattttgtgatgggatttgttttttttgtttaagagattttagagatgtggtttttgaatgtgggggtttttgttggggtgggaacgggagttggttttggttattgtttagtgattttattttagtgtttcgattttagtattttcgattttagcgttttttttttttcggtttcgcgcggagattacgtggtttgcgttgagtaattttttattgttttcgtcgcgtttttgttgtagggaagtttttttagggagttagttgatatatttggtttttattatttgtttttgaataggaatgaaaggagagagtgagtaagaaagtggtaggaggtgggggttgtagagtaggggaaggttagagagaggggaggaaagatttggaaagtttaggtatgtgttttggaagtaggtgttagcgatgagtttatttggagggtggtcgttcgttttgagttttgtttggggttagtagggaatattttgttagggtatgtcgttgggagtttgtttttggtttattttttgttgttttgagcgttgagtagatttgtttttattttagggataacgtaaggaggttgttattttattttttattttattaatattttatgaattataagtgattatttattgcgttttgacgtattttaggcgttgggttcgaagttttatgcgttttatgggatgtatttgtattatcgtcgtagaaaacggtttttgttattattgtagagaaggtatcgaggtatagagaggttgaggaattggttttaggttatatagttagaagcggttgattttggttgtgaatatagggttgtttgattttaaagtttgagttggtttgtagcgaggtttatggtttttgtgttattgtttgagtttttggtcgagttttttggtttagtggggggtttagtgatttattagttgttttattatatgttgtggatatttttacggtttatttgggtgggagggaaggggttttaggaggtgggaggggtatagggaatatagtttagtttgtttgggtttaatattttgatttttaaggtattttttgagggtagtatgaggttaagtttttgtttttttttaggattttgtttttgtgagggtttcggggttttttgtttttttttgggggttttgttggttaggattatagagaagttttttgttgttgatttttttgtttttgtattttttggtaagttattttatgatttagttgttttgtttgtaaaatgggttgaataatattgttttgtttcggagggtttttgggaggattaaatgagatttgttgtatagaagttttttgtaagttatgttgattggcggtcgtcgggtttttaagtgaatgggtattcgggtattgagtgtgtggatttagtattcggaaggaggggttggggggtatttagaatttttgggaggtttggatttttgttttgtttagattttgagtttttttttggttagtttaatttttattagtagggtgagggtaattaggatttacgtatagttgggcgaagtcgagtgattatatgtggaagtttagcgttttttatgtaaagtgggtaggcggttaaagtgagttttgttttagtttttttattttcggggttgtttttggcgttttgtttttttttagagttttattgatttgtattatgtgattcgggtttgggaagatgggtttagttgtgggaggtcgtgcgggttggggattgagagtgtcggaggagggttttttaggaaaatttagttgtataggaagtcgggttagcggttttcggaagtttttgggttttgtaagttggattttttagatttgtggttgtggggtttttttttgtttgtagttgagagtttttgattcgtatttgagggttttagaggttcgggagggggatgtgatcgtgtttttagggtgaagtttattcgagtgttattttggatatagtttttatttttttttggttttttttttggttatggggacgttgtttggggggggtttttttatatggaaggagttgtagttgagttggcgggtttcgtatatttttaaggtcgtttgatttttagtttttaagtggggttgtatttattatttaggatttggagttttagttagagagggattttttattgtttttttttttgttttttgggaaaggtagggtttttgtgtttttttttatttagggatttggtatgttgggaggttaagaggaagttgtttttcgtttatttattttttaatttttttagttagtagagttttatttgtgtgtttagaatttgtgcgtggagttagaagttataaggttggtttagttgtgtttgattttggttgtgcggttttggatagttttagtttttttggagttgagtattttgatttgtagaggagaggttgttgtgtcggtttcgtagggttttgtgtagaggggagtgtgtgcggttgtgagtttaggttatgtttttagattggaggataggatcggaatagtgggttaggatggttagagggttttagttttaggaggaggtttttatattttttagtatttttatattaggaaatgtagttaggtttttaggttttttatgttaggaagtagtatttcgttttttatttttggttgtttgggtttgagaagttgagtatttttttcgaattcgagtgttttttgatttttgtttgggtagttgttttttttgaattgatcgtttgttttatatagttttttgtggtttgttcgatagggtggttagcgagttttttgtatagtatattttttttaggagtgttgtttgtgatgatggtgtaaagggtgttttttcgagttttcggaggtatgtagtggcgtaatagcgtgagtttaggagtttcggtgagtttttggatggagaatttgtttagattattttttagtttaaattttttttgggtgtttgttgtgtttggggcgttgatttatcgtggggcggtttgtgagattttacgttatttggttattttttttagtttttgtttattgtatcggttttttggtttggttgtttttggaatatgagggtttatttttacggaagaatatttatttgtttttttttggaaagtttttttttagattttttggtcgttttatttaggttttgttgaagcgttgttattttggagaggtttttttgttattcgtagttaaaatagtttttttatgtttgtgggtggttttttatggggtatggatgagtattggagagttttgtcgtttatttgtttatatgttttttgggagggtaggggatattgatttgtgttgtgggtgttttgtatgttacgggtgtttagtgaatgtttgttaagtattaggggagtataaaggagggaagtttttgtttaattggagtagttagggaagattttttggaggaagtggtatttggtttgtttagaatgtggcgatttgtttgtatgtagatattagattagagggtaaaggttattattataatttagtagatagttataagtagttaaggaattgttatgatatggattgttcgtgattggagttaagaaggagttagagatagaggtttttgtgttttggcgtgagtttttgggggaggttgagtttttagaatgtggggtcgtttgtgtagaggtcggaggtgggagatatatttgtgagtgtcggtgagtgtggggtgagttattggggttggattagaagatgggaatttttaaatttattaattagttttggtgttttgggagtgataggagacggggtttttgggggattaatttagtataagtggacgagatgggatgtaggggaaaggataaagttttttgaggttttgggaagttgagttagggtagagttatgatagggtgagttttagaagtaatataagaaaaaatagttagattgggttttttttttattgtgggagatgttttattttatttttttcgtttttcgggttttggtaatgggttgggtatagtgaatgggttttatttgtaggagtggttatattttttgggtatagttgttttatatattgtattgagatgggattcgaggtcgggaagaatagttttttttgtaggttgatattgttagttttcggggagggaaggacggtagggggtttggagtatttttttttgttatttatattttgtgtttgtttgtagggttttgagttttgtttgttttgttttagttttggttaggaatttgttggagtttataggggtagttaggttggaataggaggagattaggtcggtaggggagtcgagagggggttttggatagtatttagggttgagttattttgggtttgttcgatttgttatttggagttgttttcgtttgtttattatgtgtaaggttttgatttattcgggtttgtttaattagcgtttttttttaggtttagttagtttggttttcgttcgatttatttattgttattagtgttatttttgtattacgtaattagtttttgtagtatgttagttattaagtttagggttttttgtgtattttttgtaatttttatagtaattcgggaggtatagagaggttgagtcgttggtttatagttatatagtaggtatggggtattgttaggatttagtcggatttttgattttagggtttttttagggttttgggtgggatattggtaaggaagtaaggtatgaatattggttttgttttggatagagttcggggacggtggtttggtaggtttagttgatatagtgattttggtgtaggtttaattattggtaaagtgtttaagtatatatagaattttaattggggagataggcgaagcggttaagggagggttgtgagtgataggtggatattgtatttattggtagattagttgattttggtgttttttggagttttttaatttttttatttagaaaaagaggaattaatagttttatttttaaattgggtgggagtattatattcgaaattgaagtaaagttggtcgtgttataggttcggtagatgttagttgtgtaggtaatttagtgattatttgaagtaggttgtgcggcggtatttttattttgtagatgtagtttagagaggttagggtattaattttgggttatatagcgatagtttaggttatagagagtagtgttggatgggagggtgttggtagttttaggtataggttgggagggttgtggggttagtagagggagggtatattttttagttggtggggtttttttgtgttttagtatttatgtgggtttaaaggagttggaaggagggaggttagagttatttatgggtttagaagttgataagtaggttattgattttgaatttgttttatcgtatgtaaattggggataaatttggggatttaatgatataatgtaagaagtagatatgttatagttttggttatatagttagtgtataataagtggtaagtcgttagaggaggtagtcggtgagaatgggagtattttagtagtttttcgttttttgtttttggttgtagatgtatttgtttttggttatttgtgttttagtttcgtgtttttcggtgtgtgtgaggttaagtttttggggtggggatttgggggtgtgtttgtagtttttgaggttaagattaaggttgaggtcgaggttgaggttgaggttattttggtgaggaggaaattgtaggtggagaagttcgttgatcgtgattttgatttgatcgtaattttgatggtgtcgatgtcgttagtacgtaggttttttgttttcgttacgattggtttttgtagtttatttggttgagaggtgtgttggttttcgtaggttgtaaaatggggatattatcgttcgtttgggttatagcgtgttcgtcgattgtatttggggagggattgagggttgattgtgttgtggggatgttggtagagaattagagagggtatttaaaaaggttaatagttcggtggggagaggaggcgtaaggttggtttttgttttttgggttttgatcgaaagggaataggggatatatttggggatagttttttttttggaggaagaagggtttagggtgttggtgtggagtttgtatagatggggataatgagttggagggtgttgggtaggagttggttagtaataggttgacgagggaggttttgttggttgggtttggtttttaagtgagtattttgagttgcggggatttagggggttttagagattttagagttgagattcgggattatagaggggtgggttgtgtttagggtaatatagcggatggggtagatgttgcgaaatttgtttttttgttttttttttttttgttatagaattggatttttttagtttatggttgttaaattttttagatgtttttgggttttatgggcgttttatattggtttttttgtaggatagtagattttgggggttggttttgatggtatttattatggggtattttatgtaagtatagtgtttttacgtttagttttttagtttgtggagtaggtttgtgtttggttagttttattttgtggttagaggagggagatagtggttttggagataggagttggtttggggttgtttttttagtttttgtttttttagtttatttttttgttttgcgggtgttggttatttttttttcgttagttttatttttagttttttttgttcgagtcgtgatttgttagtagggggtagtggaggttttgaaagtttttggagaggattttgaagtagtttttataaatttgtttttggaaagttttttttgttatatttttagcggtttttttttttttaatattttttttggggttgttatgtagcggggggtggaggaatttattaggtcgtggatagagtagagttatgttgatataaattttggttgaatttatatgttttttatagttagcggtcgattattggaattagggaagtgattttatagtaagggttcgtagagtagttattacgtattttcgattttggtttttggatttagttttggaaaagaagttagattttagttatttggagttgtttagggaagattttagtttggtgtcggttgatagtttattggaattttttatttgtttggttaggtgatgttaaggggtagaggttagaagtgttaagaagtaggtcgagggtggtggtttacgtatgtaattttaatattttgggaggttaaggcgggtgaattttttaaggttaggagtttaagattaggttggttaatatggcgaaattttatttttattgaaaatataaaaattagttaggtatggtggtgtacgtttgtaattttagttattttggaggttgaggtaggagaattttttgaattcgggaggtagaggttgtagtgagtcgagattgtgttattgtattttagtttgggtaatagagtaatatttcgtattaaaaaaaaaaaaaagaagaagaataagaagtgttaagaagtatttgtttttttgattgaaaagtaatttttgttgggcgtggtggtttacgtttgtaattttagttttgggaggttgcggtgggagagtcgtttgaggttaggcgttcgagattagtttgggtaatagaggtgttaggggtagtggcgtttgtttgtagttttagttttttaggaggtttaggtaggaggattgtttgagttaggagtttgaggttgtagtgagttatgattatattattgtattttagtttttgggtgataggatgagattttgttttaaaaaataaaatataaataaaaaattaacgtttattttttgtgattttaaaaattatatttatttgtgataaaataattaaattagaaaatgtaaaggaaatgattaataataattgcgttttttagataaatattgttaatatgtttacgtttttttttagtttttttttatatagatatttaatatttattaatttgttttgaattaaagatggttttttttgttttgtatgagaattattttagttaggtacggtggtttacgtttataattttagaaagttgaggtaggtagattgtttgagtttacgagtttgagattagtttgggtaatatggcgaaattttatttttataaaaaaatataaaaattagtttggtgtggtggtatatgtttgtgtttttagttttttaggaggttgaggtaggagaatagtttgagttcgggaggtagaggttgtagtgagttaagatcgtgttattgtattttagtttaggtaacgggagtgaaatgttgttttaaaaaaaaaaaaaaaaaaaaaaaagttgttacgttgttattttttttagggatttttattttttttatttttcgtttaagatttgttttgtaaaaggatgaggttaaatagttatgggagggtggtattggatgtttaaaaaaatgtttcgtggttggcgggatttagaaataggttggggaggttttagtagagggtggattttagttgggggtggggggtagtaggggggttttttatatgttttttttgcgtgttttatggggttgtttgtgaggtcgtgtgaattagagttcggttgggaagttatatgttatttggattttgattttttttggtagtatgattttagttaatacgtttaattatgtttttttttgtaaaatgggttaatagaaatgtttattcgagatatgatgagaaataaaggtgtttatagagtaaagtgtttagaacggttttggtatgataggagtttatatgttagtgttgtcgttggtatcgttattattacggcggtattggttgttttgttttttttttgtttttgttattttttttttttagtaggtttttatttatttgtttatttatttatggtcgaggtttcgtttgtgttaggtttggtgttgagaacgggggtagagagatgggggttgtgttttgttttttgatttaagggttttttttgtaatgtgaagtttttggagattggatttttaggttgttttattagtttttttttaggttagtttaattttttcgtgttcgttttttgagttgttagaggaagagagcgggaggaaggatggagtggggtttttgtggggattgagcggggggtgtgtgaggttttggaaatggtgtttgcggtatttacgtagtattagtttttgttgtagttgttgtttggagaatatttttggattttaggatattgatgatagaaggtggaacgttttttttggaagttattaagaggggattatcgcggcggttgagtagagttgttgatttgtgagttgtggtttgattatagttattgtttttatgagcgaggttttttgtggttttttttttaggaatttttggttttttggtaggggatagtttagggttgggggtgggtagtggtgtttgtaggtttttttggagttagagaattttttgtcgtcgtggcggggttgtttttttttgttttttttttttcgttgtgtttttagttgtttcgataggatgtttttggtttgagagatagaaattttaattttgaatggttttagtttttaagagaatttggagtttttttgtgtaaaatgagatgttttgagtatcgaggatgttgtgggggattttttattttattatttttagtcgtggtgtttttttcggttataggatgttgtagttacgttgtagggaaggagagtttttttttttgtgagtttagggagtttttttatgtagtttttttattggttattgtttgagattcgatttggtggtttttgttttaaggagtagaaagggggttcgttaggttagggtggggttgggtgcgaggatttttttcggttaatagggtttgtttaggtgttcgttttgttggggtagtagggaagggatttatatgtggtattgggatacggagaggtttttgtgtttgtgacggttaaaagggatggcgttttagttacgtttttatttatttcgaggtttagtatggttatgtcggaaatagtagtatcgttttttttattgttttggtttgtttttaataggttagaggggtggggttggagcgggcgtttgatttgtggttggatttagttgttcgtggataggttgtgagtgaatttgtagaggaagggagatgggaatgtcgggatttttttttgtatttttcgaattttcgttttttgtgagttagatggggagtgtatttttgttttttttttttgggtattttttgcgtttttcgttttaggtatttgatgttgtttgtttattttttttttttgtttttttcgttggttttttttatatggttttaattaggatttttcgttcgttggtggatgggtagagaggggagtttgttgtggggtttttttcgatcgggggattttttagtatagagttttttggtttttgtagggacgttgtgtgtgtttgtgtgagtttggcgtgttagaagcgttaagttgtagttgttttgtgcgttttttatattttttattttttaaaggttttgggtttggtgtttgtgggttggggatttgtgttggggtttttaggaggtttttggtgggagaggtagggtttttttttttttaatttgggtaattttgttttggtttgttgtttgcggaaagtgttttaggatacggtggtaggattggttggggttttggttttaggtttagttttagtttttgttagatttattttttttgtgttttcgtttattttgtttattcgtagggtttgtaggagtattttgagagttggtagggtggtttgttcggcgttcgtatagggtttgttggtgggtggttgaggttgcggtgaggtttttatggttttttcgttttgtatattttttttttgttgtgttgtttcgttagtatatgagttcgtattgtttttgagtttgtagtttgttttttttattaggtggttaagtagggtggtagttagggtggtagagttttattggtttgtaggggattttttgtgggttgtaggtagttttttgtggttgaaggtgttttggtaggatttgtattatgattttcgttaaagtttacgtttaaggtatttgtgggtattttcgttttagacgtgagggttggtatttttttttgtacgtgaagtaaaggtttgtttgaaggagcgtgtggaagtttgggtgtgatgaaggtaaggatcggtggtttattttttttgtatttggattttgggtggtaggtttggggtttttagtttttaatttaggagggtagttagtcgttggaattaagagtgaattttagttgttgttgttatagttggagggaagaggggaaaggaggcgttgtaggggagtagagattttattttttttttgtcgatattaggttgtcggtgttggacggggttttggtaatcgtggtaggagtggtgatgttcgatgatggtaataagggttttttgaggatttcgagttgttttaagggttttttatttggagtaagtattttttttaatttttttaataatattgtgaaattgattttgttgttatttttattttatcgatgaggaatttatagtttagagatgttaagtaatttgtttaagtttttttttgagtatggtagagggagggttcgaatgcggaaagtttggttttagtgtttttatttttaattattgttatttattttttcggttagttttttgattgtaaaatttgaggtttagaggagtgtagtgatttggttagtttcgtacggtaggttagtggtagagttgagtagtgttttttatgttttgattttgtggttttttgaggtggtttatttttaaatacgttttttatggtggttttgttttttttttttttttgaatttgttagtttgtgtttaggtagggggagaagtagagtaattatgtcgggcgggtcgtcgtgttttagtgtcgtttgttttatatttgattggtagtagagtggtttttttttggtgtggtttggaggtgttagtggttatttattagtatagtttagttttatatatgttatttttaaaggatgttgatatagaatgaagtagttaggggaggcggacgttttggtacgagggtggcgtttttggtaattcgtagtgttgttgtttgtggttgtttttggttggtattttatttttttttggttgttttgtagttatttgagggaggttagtatgtcgtttttattttaggatagtgtgaatgtagtagcgtaagtttgttagcgtcgtattgcgggatttggaggtttttgtttttgagttttgtttttgtgtaatttttaaagtacggattttttaggggtttttatttttttatttggaaaaattttatatcgtttagggtttgaggtagggttagagtatggagacgttgttggaggattaagggagaattgagcgcgtgtttttttggttttagtttcgtgtgtgtgtttatgtatgggtattttgttatttatattggtttttacggttgggtgggagttgagttgagttcggcggttgtttttttattttgcgggtttggttggggagtgtgaggatgtttgttggaagttaacgtgtacgaaagagttaatggtggattttatttttttagttttttttttagtttttttagggaaagggtaggaatagagaggttttatttttagaggaaggggtgggcggggatatagcgttgttcggtatagttttttttgagttattttgtatgttttattttatcgatttttgtagtttagttgtttagagcggatttagaaggtggagagagggtttttaataagtagaggatggagtgaatgtgagatttattattgggatttggtaaagtaaagagttttatttttttttcgtagatgggacgggggcggggttggagttagcggggtgggggtatttagtaagagtttttttttatttttttattttttttgttatgggtttttttttttacgtagatttttagtttggaatgattagtgtttagtttttttcgttttttttttgtttcgttggagggagtgatttggtttttggtttcggttatttatattttttgttttgttgtattagtttcgtggtaggggttgcggcggaggtgggtaaaagtcgttttcgggtagttagtttttattttgggagtgattgaaagtttttgggggtttttgtagggtgagttgtttattttggttttggtaaggatatttaggagagggttagggtgtttgtatttggggtatagtataaagaatagtcgtaagtgttttttaggtaggagggtgtcgaagtattgggaagttgggatttagaagtattgtttggggtggtgagtggaagatgtaggatatagatttacgcgattgtgtagattatttggttttattttttcggtttatagtggaggaaattagaggtcgagagaggtgaagtgagttttttggggttatatagtttagttaggtttagggcgtcgattttttgttttgttttttcgtgtttattcggttggtattagtatttttgttttgatattttcgtgtggtagttgttgtgattttgtgatttttttttattttattttagtggggttttgcgagggaaagaagaatgttttatgtagaagtggttggaaagtaagaagtttggagagaagtgaggtttttgtggtttggtttgagtttaggatttatggtttggtttttagggatggagtatcgattttttttttttatatttttattttacgtttttaggagttttttatggggaagtcggaatggatttgggtttagagattgtaaatttattttgttggatgtgtggttgtttttatgtaattaatttttttacggagaagttaggggatggtttttagtattttcgggggttttttagtgaggtgggaggatttcgagaggttaggaggttgtttaagattttttgttttttagggattaggtgagggtttgtcgattgttttgattttttgatgtttttggtggggagattttagaggggtttgtcgttattatcgttagtggttttggtttgtttagttatttttttggggtggttaaattttatgttgtaaaagtttaagtgaattttagtagtggtttgggagaattatttgttacgagttaaggatggagtttttggggaggattttttgttgttttttaatttttttcgggtatatttttttgtagttttattttttgtaagaaagttaggtgtttttcgaagtttttttttggttttaggttagaggtgatagtgggggttttttgtttgcgttggtgattgtggttggttgttggtgtttggttttgttttgtattgtgtatttattgaaggcggtattattcgggttttttcggtggttatgtatgggtgagtagtttacgatatatttgtttttagtatcgtgtgggtcggggtttttagaggggttgagggtttggatggttttgtaggggggtgtttttggttttgtgatcgaaaggagttgaaggtttggagaagtcgttgggtcgaggttagtttttatagatttggcgaggagggaatagatgtttacggagttgttttaggtattgtatatattgttttattttgcgttgatagttaagaggttggtttttcgtcgatttttattttatagataatgtgtttttttagttttttagtggtggagttaggattcgaatttacgtaggtagttttttgggtttgtagttttattttttatttttttttaggatttatgttttggggttggtaggataatgatttttagagttgagtatattttaatttttagtatttgggattacgttaggtgatatggtagggttagttaaggttattaattagttggttttaaaatagggagatgattttggatgatttatacgggttcgttgttattataagagtttttaaaagcgtaatagattatttgaggggtgtagtgggagaggtttggaaggaggaaggaggttataagttaagaaatgtaggtgaatagaaaatgtaggaaaacgtagttttttttgtagtttcgggagggtgcgtagttttgtggatattttttttgtagtttagtgaggtggagtgtgggattaatttgtgttgtttgatattataagtgtgtggttatttgttatagtagtgatgggaattgaatgttattaggtagtagtgtttttatttcggaagaattaggataaatttttttgtggattttaagttttgggagattttgggtttttttggattgttttagttttgtaattataggaaaggttttttatgtttgtttgggagaagaaaatttcgtagtaaatttatttttttttttgataaatgaaggcgagggtgtgggttggatatatgttttttttttgtggattttttttgttttaatatttagaattttgtagttgaaggagattttggggggttgtttgtttgatttgtaagtgaagaaatggaggtttagggaagttaagtgattggtttagggttatgtagagttatgttggaatattaagttagatagtttagtttttgttttaaagtgtttttttttttggttggggaggagggttggagggagtggatttcgagtaatagtagtattggtaggggttggaagagtagttattgtatttaggtgttggagtttttggttattttttgtaggaattaggtgatttattatggtataggtttttttttgtttatttgtagttttgggggttttagggattagaggatattttggtttgagggttggggtttgagagaagagatggaagtatttttagtttggtttgttttcgtggcgttttgtaggtatattcggtagtttaggggttttagagaatttggttggtgggcgtttttattttgtcgtagttgtattttgtggttagtagtttgtaggatttgggttgttgtttgtggttttgaaatagttattttttgagttgagtggggattaggtgagtagatttttatattttaattgttgtgatttttttgttttggaggttggtgggtagtttggttggtgttttatggtattttatgatcggttttgttattaggttcgtgagttgttttttttttttcgggtattttgaacggtttttttgagagtttcgttttgggttttcgtttttgtaggttttcgttgtttggggcgttttttttttttggaagttgggtttttttggggatttattaagaagggttttgtcgagtgttgttaaattgttttatttggtttttatttgttttatttattattttattttaatttttatgttttttttttggttttaagatttgagtaggtagggtttgtgaggtattttaggttttttgatgttgttagtatttaggggattgttagtatatatgtagggagggaaggaatgaaggaagagatgatttggggagttttttagtttttatttgtaattggtatattgcgataaaatatttatggtattttattttttttatatattttttttttaaatttatttttatttgagatggagtttcgtttcgttatttaggttggagtgtagtagtataattttggtttattgtaatttttatttttcgggtttaagcgagttttttgttttagttttttaagtagttgggattataggcgtttattattacgttcggcgaatttttgtatttttagtagagatggggttttattaagttggttaggttggtttcgaattttcgattttaggtgattcgtttgttttcgttttttaaagtgttgggattataggcgtgagttattgtatttggttttcgtatatttataaaagagaatttgtttagaaaattttttagatgtatttttagggttttaaggtatagatatatgaagtttgttagtgagtagttgttgtttattttttttttttttttaatttagagcggtttgcgttttaagcggatagttgtttttttttttttggttttttgttgtttacgtttttatagaagtagggagaagaggtaggaaggtgacgcgtgattattcgttgggcgttcgtatagtgtcgtttgtataggtgttattttttttatttgttatttttttcgttgagtttttttttttttttgtagatgagagagtattgttttttagaggttaagaaatgggtttagagttatttagttgattagcgtgtagttagatttgaattatattttgttgatttttatgtttgtaggtttggtttgatgagatggatagttgggtggtggagattttgagattttggatggtttttaaatagggtttgtagtttttggatagggagagtttggtataaagggtttgtggagtgagttgggggagaaggtggtttagggtttttgtttttgaataaatagatggaggggttattttagcgtttttttagtttttggtgtgttgggtttttggttttgggaggagagaatggagttggtttttattttgggttgggttggtttgggtttaatttagataagttttttagtttgttatgagtgatatttttgtttgttttggtgtttttgttaaaaatatgaagggttttagaatttttatttcggtttgttttttttttagatttggagtgggtttggggttgataatagttttatgttagatagtttgagtagttattagtgttattaggtttgatattgcggtttttgtttcggagggaaaaataaggttttttttgggggattttttgttagtttgtgaaaataggtttggagttagttagcgtttttatgtttagatatttcgtgtggtttttaaagtgtttttatgttgttagtttatatgattttttttaaaattttataagggagggtaggaagtttgagtaatagtttgttaagtatttatatagtaggtggttttattgttttttatttatagataagtaaattgagttttagggtggttatcgtttgttttttaagttatttagttatttagttacggaagaggttatgattttttatattttagtgaagttgaagattttttttttcgtttttaaaaatgtttattttttagggtagtgaatatttggtgtttttgtttagcgtaagaggtgaacgtttgttattttcgtttttttttttttattagatttgattttttttttgtgacgggaatattttgtaggtagtttgttttgtttttatagattttgagaaacggggtttaaattgtcggttgtgggtgggataggcgatattgtagtgaagaggtggagtatttttgtagcggggaagaaatatattttttttatttttttaggtttagtgtttgggggtttgtgaattaaatttatttaagataaattaatgagagaaaagatagatttaattatatacgtatgggattttattgaaaaacgtgatttaaaagagtaggtagaaggtggggttcgtgattggttcgaaggtagtgagttattttagttgattgtttatagttagttatagattagattttttgttttattgttttttttttttttatttgttttgttttttttgagttagagttttgtattgttgtttgggttggagtgtaatggtacgatttcggtttattttaattttcgtttttcgggtttaagcgatttttttgttttagtttttcgagtagttaggattataggtatttattattacgtttggttaattttttgtatttttagtagagatagggttttattatgttggttaggttggttttaaatttttgatttcgtgatttgtttatttcggttttttaaagtggtgggattataggtatgagttattgtatttagttaattagttttaaaaaaaaaaaaaaaaaaaaaagaatttagggttcgtatattattttaataggaaaaaaggaaggggtgaaagtatatattatgggtcgggtgcgatggtttacgtttgtaatttcggtatttcgggaggtcgaggtaggtggattatttgaggtcgggaatttaagattagtttggttaatatggtgaaatttcgtttttattaaaaatataaaaattagtcgggtatggtggtgtatatttgtaattttagttatttgggaagttgaggtaggagaattgtttgaatttacgaggcggaggttgtagtgagttgagattatattattgtattttagtttgggtaatagagtgagattgtgttttaaaaaaataaataaaaaaaaaaaagtatatattatggtaaaataaatgagtttttggaaagataaataggtttttaggagttgagatgggagatgtgaagttttgtgataatgtttttttaggtgtggtgtggaaattatttatattttttagggaagagttagttgtttttagggagtagatttgggtttgtatattattttaataggggaaatggaaggggtaaaagtatatattatgggttgggtgtaatgtgtttagtgtaggaggtagacgtggtttatggttgttgttgaaattagtgtagggttcgattgttttgtattgagtgttgaggattttggttttgtattagttatgagtttgtagttttgggatatatttgatgttggtttaaggggaaatgaggttggaggggtagggtggttggattggatgtgggtttggggttattgttgatttataaagtggttattatacgggaataatagagttggttatagattataattagtaatattatttaaaagtaaggttatatttttaataataagttatattttaagttattattaatttataaaatatattgttggtataatgatagttttttaagaaggatataaaaaggtatgttgggttgggtgtagtgatttacgtttataattttagtattttgagaggttgaggtcggcggattattttaagttaggagtttgagattagtttggttaatatggtgaaattttgtttttgttaaaaatataaaaaaaaattagtttggcgtggcggcgtatgtttgtaattttagttacgggggaggttgtggtagaagaattatttaaaatttgggaggtggaggttgtagtgagttgagatcgcgttattatattttagtttgggtaatagagttagatttcgttttaaaaaaaaagaaaaaaaagaaaaaaagtaaaaaggtatgttgaaggtatttgtttgtggaaagttgtaatttgacgggaggtagggcgagtattttttagaaaggtggaaatgggtttttttgttatagagatttataaatatagattgaggtttgtagtttaggagatttaaaagaggtaaaggtgaataagagttaaggtttttaagttagggtttgattttgggggtgggggttatatatgatggaggatgttaggagggttttttggaggtggtgatatttattaggggggattttaggtggggtttgcgagatagtaggatttggttgaagagcgtaggttttttagataggagtgggaatttaggtttgaaaatgagttggttagattgtaggggttttcgaatgtaagggaagaattttaattttaatagaggagtttgggaagttgtttgggaaaaggagtgataaagcgggaggggttttttagtagagttttgtatgggtaggagggagcgagatgggaggtgggtgttggtaagggatgattttagtggtttaggggagtagttatagggtggaaattaattttgtggggtttgggtaggaagggattgatttgagatatcgggaagaaatagttagtaggattttggtgagagggttgggggtcggggaggggggtgtggagagtgggagtttgagtttttgaaaatagatagtgttttaagggggagatttgaggtaagatgtggagaggtagttgagttgggaagttggaacggaggtgtggttattttaggagattaagttagggggcgaggggatttttgggagttatttagattttagtattagggaatacggaggggagaaggaggggagaagaattagttggtgcgtgttaggtattgttttcgaggttagatggggtggggttggatattggttatgaggatttttttaagagttgggttaatagtgagacgggcggatattagatggttcgggttaagaagtaagtgggcggtgggaagttagaagtcgtggtgtagatttattttgagaggttgggttgtttagatagggagaaagtttatagtttgaggaggtagataggttaaaggaagagggtttgtttgtttttgagattggggtattttgaacgtttttttaggttaagtgagaagaaattagaagaggaatatgttatttaaatgtgttgaaatagtttagtagttgcgttgttttatagaaaatgtgtagaggtttttttgttttattatgtttgtttggggacggtttttattcgggttatttagggtttttttagtttgttaatttaagggtggtaggagttgtgggtgtttttagtttttttttaaggttggtttgtgggtagaaatgtgggttgtttcggggcgttatagttataaatgtatattagtttttagaattatatttttgttttttagttttttttttcgtatttttatgtagaagcgcggtcgttagtttataaaggatagggagggatattgtttttggtatttgatgggaagtatttgttgtattttattggggtgttgtttaggatggattggaaaagagttggtaggaaggttgagttttgtgtttataatttggtttggtggtggtcgaggagtttggtaggagtagagtgtaggatttgggaattgggggttggtgtatgtgtgtacgtacgtgtgtgtgtgtgtgcgtgcgtgttgggtgggtagggaggaagttgtgaaattatatttttttttttttgttgttgtgttgttgtgtgttttagtagtacgtgggtgttattatattttttagtaggtgttaatttttaagattgttttgggttttttttttagttggttgagttggaggtgggagttttaattgttttttgtggtttttagagtgggattttgttgtgggataggttggttaatggtgtttttttttttgtgatttttttgttgggtgggttacgaggaaggattgtgggtgttgtttatagataggtggatatgtggtaaggatattttgggattttttttttgacgttttttgaagggggtatttttttagttttgagatgagtttttgtggatgtgggaagtttattattttaagagtagtagttttggaaaatttaatatagaatttcgagtaggggcgggaaggggttttgtttcgtttattggttgtttggtagagttttgtataaggaagcgtttgtgttgttgtgggcggaggaatggattgagggttatattcgttttttgttgtcgttgtaattgtttattataaatttagtggtttaaagtaatagaggtttttttttttatagtgttaagggttagaagtcgattagttttatcggattaaagttaaggtgttggtagaatttatttttgttttttttagttttgggtgggaggttttgttggagttttttggtttgcggttgtatttttttagtttttgtttttatttttttatagttttttttttttttgtagttagatttttttttgttttttttttttttttttttgagacggagttatttaggttggagtgtagtggtataattttggtttattgtagttttcgttttttgggtttaagcgatttttttgttttagtttttcgagtagttgggattataggtatgtgttattatatttggttaatttttgtatttttagtagagatagggttttgttatgttggttaggttggttttgaatttttgattttaggtgatttgtttgttttagttttttaaagtgttgggattgtagttatgagttattatatttggtttgttttttttttaaaggacgtttgtgatttggggtttatttgggtaatttttttattttaatatttttagttatatttatagagtttttgttgttatatgaggtaatatagtttgggaagggagagttatttagtttattttaggggtttgtggtgtattttagggtttttttgattttaagatataaagtaagaaaataaattggtttaaggggaaaaaaggatacgttgaattttgttgttttaaatgtatatttttttattgtgttaaaatgtatagaatataaaatttgttattagtaatattgagtatatttatagtgtcgtgtaattattagtattgtttagcgttagaatttttttattattttaaagggaaatttcgtatttatgaaggatttattttttattcgttttttttagtttttggtagttattagaatgttttttgtttttataaatttatttttaataagtgtaattttgtgtgattttaaaataaataaatatgagtacgatgagttgtttattggaaggatatttatgcggggaggtcggcgtgtggagtgcgtaggttttcggacgggtaggagttgaaggggcgtggatgtgtcgtttttttttttttttgttttttttttggggttattgtttgagtatttttttttgtaaatggttttaaataatgttttagtttttacgtttgtatcgttttttagttttaggattttttattaaaaaatattttaagttttagatttatttttgggaaaattttaatggttttatttttttttttgagttagttagattttatggtttgtggcgggttgtttttgagttttgagtatttgtgagttagggaagtaggataggtatatttagggaaggggaagagtcgtcgttagttatagtaattgatatttttggaatcgtttaagagatatttagcgtgtgtttaaaatatttatttttttttttgtttgttttttgagacgaagtttcgttttgtcgtttaggttggagtgtagtggcgtgattttagtttatcgtaatttttttttttcgggtttaagcgatttttttgttttaattttttgagtggttgggattataggtatatattattacgtttggcgaatttttgtatttttagtagtgattgggttttattatgttggttaggttggttttgaatttttgattttaggtaatgtgttcgttttggttttttaaagtgttgggatgataggtgtgagttaatatatttggttatatttattttttaggagaagttttgtattttttgaaagtgaaatgtttttaggcgggtgatattgatggtgggatttgtggttttattagtgttttatgagagatgtcgttgtgtgttttattaagttgtattttattgttttttaaatgtggtttgtagatatggtgtcgagaatgatttgggaggtttaaattataatatggtttaaattaatagttttttgatgatttggtattattttaggattaaattgagattattcgaggatgggcgtggtggtttacgcgtgtaattttagtattttaggaggttgaggcgggcggattaattgaggtttgtagtttgagattagtttggttaatatggtgaaattttatttttattaaaaatataaaaagtagtcgtcggatatggtggtgtacgtttgtagttttagttatttgggaggttgaggcgggagaattgtttgaatttaggagacggaggttgtagtgagttaagattacgttattgcgttttagtttgggtgatagagtaagattttgtttttcggtaattaaaaaaaaaaaaaaaaattgagatttttcgagttgtattgtttagtatgatagttattggttgtacggggttatttgaatatttgaaatgtggtgattttaagtggagaggtgtcgtgtgtgtgaagtgtattttgggttttagagttttagtaagggggaaagaaaagaatattaaatatttgttatttttatattgattatatgttgaattgataatattttgggttttgttaagtgaatgatattaaaattaatattatttgtttttatattttttaatgattttttttttttttttttttttttttttttttaaatatggggttttatattgttgtttaggttggagtgtagtggtacgatttcggtttattgtaatttttgttttttaggtttgagcgatttttttgttttagttttttaagtagttgggattataggtggttgttattatgtttggttaatttttgtatttttagtagagatagggttttgttatgttggttaggttggttttgaatttttgattttaggtgatttgtttattttagttttttaaagtgttggtatgataggcgtgagttattgtgtttggtttgtttttatattttttattgtaggtgttggaaaatgtaaggttgcgtttgtggtttatgtgtcgtttttgttggagggttggatcgagggttagtcgagaaggttttggggttgttttatttgaatgttgagtgtgtgttgagcggtagagaattttgagaagtgttgaaggatagaggttttgtgtgggggatgtagttttaggtcggagatgttttttttgtgttttggagatttttatttggtgatagtaagaggaattattgtaagaggggcggttattttagtaaagtatttaggatgttggttttttagtttaggaatttagaggtagaggaggggaggaggttgggtttggaggagagtagggttttgggttttgggaaaagtttggggggttagaaagttgggggatagattgaggttagaggtaaagagaagaaggttcggagaggagggttaaggaagaagggttttgtttacggggagggagaggtttacggggtaggggcgtggtgggagttgtattttcgaggttttttgttgattttgatatttggttagaaaggagttttttttggtattttttgttagcggtttttggagttgttttttaggggttagtgatgagggtgttttgggttgggttgtagatagtggaaaagataggttttttttatttttagtgttggggaaattagttttttggaggaagggggagttgtattttttgagtggtcgtattttttggtttagacgtgtgtgttttgttgtaattttggcgattggtgttggtggtgtttattttatggatggggaaggttaaattttatagatattgagtgataggtttagggttttggattttagtgtttgatttagaatttaggtttttgatttgttattagttttttttttatttagatgggaatagggatttcgggtatgtagtttttttttagatattttttcggttttggtttggcgttcggagattagtagtagtagttttttacggtcgtttattgtgagggtggggagggtcgtgggattaggaggttttagggggaaagttggttatgaggagtgggaagcgacgggttagatgttagtgattgttggttggggagtcgttggacgtggttggtttgtttggttagtgtggcgggtgtttcggggttttagttatttttagttacgtgtgggggtgcgggatgggaaaggtaagagtgtgtggagtttagttagtatttaatatgaggtttcgtgggggttgtttgagggcgtagtttttagaatttagtttttggtttttagaaggtgttattaaaggtttttttttatttgagtgaattttttttagtttttagtaagttttcggaacgagtttatttttaggcgtttttttttagtgtgggagtggttacgtttttgttgggagtgatttatttgggtttagaggtcgtggtattgagatgggtttggtagattttagcgtttaggtttagtttttatagtgttagtttttttttttggggatttttttgtttgtgtttttttgggttttagtatattttaggtttgtagggagggggagaggaagagattgatttattggttaggttttttaggggttggagaggttggagaggtaggagttggattagatttgaatttagaggttttcggaggaagagtttagggtgagttgcgtttttattttttgtttttttttttttgtttttttttttttttatggttttagttagtaagtatttggggtagaggggataaatttaggtggttgtgttttagttttggttgtaggtttgaatggttttttggggtggttggttatgttttttgagagtttagttgtggcgatgtttgagtaggtaggtgggggagtatttaggaagtaggggtgttaggtagagtataaggagagagggtgtttaggttagttttaggatttggttgagaggagggggttttttacgggtatcgtttttggtaagtatagggataagggtaaggacggtatggttagaggtttttgggagttttttttttttttttttttttagtagtttttttttattttttttagggattttgttatttttttttagcgtgtggtagttttttggcgtttttttcgtgtttttaggttgtttttgcgtcgggtttgtcgttgggcgtttttatttttgtttgttttttttttttgtttttttcgttttgtttttttggagtaattttttatcgagtttttttttttaggtagtcgaggtttttttttatttttgtttcgcgttttgggaggttttttgtttcgcgattataaagtttttttgattttttgttcggttttgagttatgtgattcggtgggcgggtcgcggttttcggcgcgtttagcgtagttcgacgtttcgttgttggggtgagttttgtttttttgttttttttagttttgtattattggttcgggggtttttaggtggcgcggtcgcgaggcggattttgatggttatggtggcggtgtcgggagttacgttgtttttgggtttcggttcgaggtcggtaggatcgagcggggtttttaggagaggggtggcggggagttcgatttttacgcggggattagattttcggttttaaaatagaagaatagggttttgtgtggttatagttatttttttgtaaatatttggttaattaagttgagtggttaagtttttttgttgttcggagttttttggaatatgtttttttttcgtaaggggtttttttggtttttaggagggttaggaagaaattcgaattggttatcgttttttttaaaattatttcgtttaagttattatttttttgggttttcgaagatcggttggttggaggttggagatagttttaatgttcgaaatgtcgtaatcgaagtttttcgcggcgtcggtattgggatttagggagttgttgttatagcgtagttttggatttttggatgtgttggatatgtgtagggcgtttttgggaggagcggggagggagggtgttgttggcggggttggtttgcgtgtgttttgtttttttataatggtatgttgcgtgtcggttatgtagaggtatgttagtgagtaggggttgagggatttttttaacggatttgtttttagagggtttttttatgttgggagaattttagagattaaattatgtagttaacggggtggttttcggttttaaagtagggaggggcgaggagttttgtaggtaatgttatttgtttttgaaacgtcgttttagtgattttggggattgatttagtttttagtttgttgtattttatttttggtttttttttttttgtttttttatgtgaaatttgttgtgttttggttagaggtttggggaatagttttttgtttatttaagataagtttgtaattttttttttggagaaaaatatgttattcggaagtaggttgagtagtggttttttggtaggtttgttcggggttgtggagatagtatttgttggattaggatggagttggaatttggtttggattttatatgagaaaattcgttggaagaggaggaagtagaaaaaggttttattttttaataatgttgtgggttttttttttttatttattgttattttgttttgaaatttaatggggttacgtgtgtttttatgaatgttattttttttggttaattttttcggtagttttaggagtttttttttaggaaaaggaagaaggtgtttgtttagtatttagtatacgagtttttgttggaaaggtgggatttttgtttttttttgggttttttttaggttgagatgtggttaaggaaggtttgtggtgtggttcgttttttttaatgttcgtttttggagatttgagttgttgttgatttttagtttgttttttttgttttttggttatttttgtgtcggggtggttgagatattattgtattggttattttgtgtttttattagttttcgtttttgtaggttgttattgtgatggtgatggggttaatttagttgcggtggggaggatttattgtgtgcgtttggggggtggcgtggggtattttgggatgagaagatgcgatttttgttttgagagttttgttttaatggaaggcgggggtatagttgtaggtagaagttattaagtattgtggttagattagtattttatgttaaaaatggttttgttggtcgggcgtagtggtttatgtttgtaattttaatattttaggaggttaaggtaggtagattatttgaggttaagagttcgagattagtttggttaatatggtgaaattttgtttttattaaaaatattggttaattcgggtatggtggcgcgtgtttgtaatggtagttattcgggaggttgagataggagaattatttgaatttgggaggtggaggttgtagtgagttgagattgtgttattgtattttagtttgggtaataagagtgaaattttgttttaaaaaaaaaaaaaaaaagttttatttgggtttgggatttgtttttcgaatattgggtttattgtgttttataaggatttttatttcggaagttttagatttatttgggtaattagagtttttgggttgattattttttagttttggttagttttttgggttatcgtatttttttaattttttgttgtgttacggttggtttaagttgtttttattagataatgcgaggtatttttataggaggggataatttcgtttttaggagttttttttttttgtttttaggtttggtgtagtgtgtggtttttttgtcggtgttaaaggttttaaggtttttttaagaagtttgttattattattagtagttttcgttatttggtttttttgtatatgtaagttttttttatatatttcggatgtttagggttttcgttttttttttttggtcgggagtgtgggaagagggttttattttaatgtttgagagtagggttaatggttagggtaagttgtgggggttttttttcgtcggtttttttttgtagtttttattttaatatagagtatcgatattatttgggttttgggaagatttggaggttgattattttggaggtttttagcgttttatagttattttttggggaagaggttttttgagggatttgtggtttttggttgggattttagttttagagttttgtttttcggcgtcgagttttgatttgtttattgagtgttagttcggttttcggataggtagggatttgttttcggagtttagtagagttttgggaagtttttttaggagggttttcgagggtggcggttatgtttagttcgttgtacgtgtgagtttgtttgatgaggaattggttgggaaggcgcgggtttaattataggtttatgagggtttttttcgtttttatttaggaagtagcggagattttggtatatttagtatttgggtttgtgtttgtttagttgttggtggaattatgggagttttgtttcggggtttgtagagtagtagtgggaattttttttattttagttttttttagagttggttgtttaaattcgtcgtcgtttagtttttttttttttttttttattaattttgggaatcgtatattgtttattttatcgggtttcggagcgggtgtaggaagagagagtttaatatttagaggtttgggttttttgtaggcgtttgagttgttgtggtttgagttgggttttttgttggaattattatagtagatttaatgatttgtttgtaggagttgttttattttagtcgatttcggggttgcgggaaggggttgggttttggttttgttgggggtggggggttagtgtaaagggtttgaaaagtggtagaggtgatggtttatttgttttttttttggtcggtcggtttaaacgcgattggttttttttttttttttttttttttttttttttttttataaataatattaaatgcgatttgttaatgtatttatttgggtttagtagttggattatgggtagaagtattttagatttgttattttttttaagttaagggtggggaatattttttgtgagattttggtttttgagcgtttaagattgtttttggaattttaattttgggtcggttttaggggattgacgttgatggagttgttgatattgattttcggtttttgtatggtttttaggaagggggtttttcgttttttgtttcgtcgagtttggttggtagtattttttttttaggtttgtgttttcggtagggtttgttgttttcgttttgttttgtgggtgttaggttttaagtattaggtgattcggttattgaatggttattgaatagttatttttgttggtgtttttagtggaatgtgtatggacgtttttttttttttagatttttgttttttattttttagtttttgttttaggggttattataggattaggaggtacgtagacgtgggtggtatatttattgggtagatttagttttgaatttgtacgttttttttaagggggtttttagcgggcggggttgatggtgtcgtttttttttttgttattagaacggatatgaggattgtgttttgtcgatttacgttttgagtttttagacgttataggtgtttgtttaacgagtgtttgaatgaatggttagtattgtgtgatcgtagatttttaatttttatttaaatagtttgtggtttttgtgaggttatttcgagatagttttataagaatttttattttttttgtacgtttcgtataaggtttttttggggggttttttagaaaaagggttaaagagtagtattttttcggggatttgaatacgatttttttcggggtaggggattgttttggaagattttcggtatcgttttttatgcgttacgtgattaggagggttttggggtaggatggtgttttttgtgttttgtgtgttggggtcggaggaaatattgttcgtggtcggtgttatttgttagttttgaagattaatgatgggttggatagtggttttattgagtgggagggagaatcgttgttgtttgtagttggggggtcgggtgggtgggagtcgaggttagggagaatagcgtagatttggtacggagaggtttggaggaggagtagggggttttagttatttagggtgtagggacgttatacgaggagtaggtgtggtgtgcgtttttttgcgggttttttattttttggtttcgttatttgtattaggttttgtggtgagagggtatagagtggaggaaggtgtcgtggttagggtaggttatacgttgtgttaatggattgttgttatttgtcgtttttgtggttttgttgttaggattttttagtattaggtttttattattaggtatgggttttataggtattattggtttttcgaagttagggatagattttatagataatattgagtttttgtagttagggatgggtttttacggttagtattagattttagggattagtatcgggtatttatagttagggataggtttttatggttagtattaggttttagggattagtatcgggtatttatagttagggacgggtttttatggttagtattagattttagggattagtatcgggtatttatagttagggacgggtttttatggttagtattaggttttagggattagcgttgggtttttatagttaaggataagtttttacggttaatattagattttagtgattagtattagatgtttatagttagagatgggtttttatggttagtattaggttttagggattagcgttgggattttggatgattgaaggagggtacggttgattaaagttgtaggagttagtttggttattttgaggtattaagttattattgcggttttaggggatttagatttttttatttgtttttttgaattttggaattagatatatttgggtttagtttttgttttcggggttgtgtgtttgggatggttgttttatttttttgaagtttagtgagatggggacggttgtatagggttcggtatagatggtattcgatggtatagggttatttgtttgtatttatatagtttcggttttcgttttggttgcgtatcgagagttttatgtttagatttttgttgagtttttaagtttttggttatgttttaggtttttcgtgagaagtattattgtatggattatgtttcgggattttattttgggttgggaagtttgttttatttttttaagttttttttagaggcgttttatgttttattatttttattgtttgaggggttagataggggaatttagtgtgggaggtttagaggtgtcggagtagacgttaagcgagtttcgtgtttatgcgttgggttttggtagatattttgaatgagttttttttttaggaaggagattggggttttagtttaagttgtggttttaaattttgtgattaagagtggagaaaaggtaagatttttttttttagttttttagaatagtcgatagtggtggaaatatggggtttatattgaatttttttgtaatttgttgaagagaatttagtttatatttttaggggtggaggtttggtcgatttggtagtgtgttcgtttttttggttatagtttattttggatcgggtattttggtgtttttttttagtgacgtagtgaagttattatgacgtgtttagttggtgagaaagtgttttttgtaatgttttattttttttagagggtgaataagttttgtttattataaataattatttatagaatatatgaggtttaatttaattttgggttacggtagcgttttttgggtaaatttacgcgttattttagttagagtttgtgtttttataggttttttggatttattttgaaggggggttggattttttgtttgtttcgatgagagggttgtaggatagtttttagcgagtttttttgagggttgtaatttttttttttggtatttttttgttcgttaggaatgttttaagtttttagtagaagtttatttattatagtcgttttttattttgtttattattttttttgtttttatttatttagtagatttcgtgtatagtttagtgtaggatttagggtgggaaggtgtttcgggtgggttggagtaaggtttttagttagggcggggttttaaggtgggtttatagttaggattgtgatttgggaggtttttttttgttttgttttagtttcggtatcgtcgttgtttttgtgtttagtggagatttattggttttaggttttaaaattttagcgaggtttgtagatagggaggagttttattcgagggtagagtgattgtcgggtttatttgtttgttacgaattacgtggttttagatttgttatttttttttttttagagttatggttttttgtttgaaaaatggataatgatggttattatgttagggattattttgaggataaacggggatgaaattgaagaggtttagtacggaatttggatatagaagtgttaattgtgtgttattagttgcggtggttgttaaggtttaattatatggtagttacgggttgagtggcgggcgggaagtggggagtaggagtatgtaagatgggtatttttgaagtttttgatttagtgagataagtatatatttagttttaagatggagtgttttaggaaggtggagattgtaaaggttttgtggcgtaggagtgtgagttgtatttttgggttttttagaattttattagagtttagggaggaggttagtttagatataggggtaacgggagagatgggagtgagaaaatggtttggcgtttggaagtggagtttggaaaggtgggcgtggggatagaggagggttttgggggttatgggtttatgcgtttaggaggtggaggtagtgaacggggttacggtcggttttatacgtggtattattagttttgttgagtttgtatttgttttttaggttttttgagtgttattattatttggtattttttggtttgatttttgttttttgttcgtttgggaagagtgagattatttgtttaaagttttttagttgtttttaattattttggttgttttttggttttgtttagggttagtcgttgatttgaattgtttggtgttatttttttagatttttggggttttgttttggtattaatagttatttttatttttattatttattcgtatatttatttagtagtgttttttgggtatttatttagtaatattaaggcgttgagatgcggttgtggttaagattcgggttcggtttgtgaggatttcgtagttgttatttttttagagtatagttttagttaggtatattgtggggtttagaaagagaaattaatatattgtgttcgtttattttgagttgttataaggaatagtcgaggttggggggttatttgatttacggttttgtaggttgtataagtggtgttagtatttgtttggtttttggggaggttttaggaagtttttttttatggtagaaggtgaagggggagttggtacgttatatggcgagagagagaatttttagattttttttttttttgaaatggagtttcgttgtgttagttaggttggagtgtagtggtataattttcggtttattgtaattttagttttttgagtagttgggattataggcgtatgttatcgcgttcggttaatttttttgtatttttattagagatggggttttattatgttggtcgggttggttttaaatttttaattttgtgatttatttattttggttttttaaagtgttgggattataggtgtgagttattttatttagtttttttagattttatagtaattagatttttcggattttgtgatcgtggggagggtattaaattatttatgagggatttatttttatgatttaagttttattttttttaggttttatttttaatattagggattatattttagtatgagatttggaggggataacgtttaaattatattatacgtgatttttttgtgcgtgcgttagtttttatatttggttaagtagtagaagttttttttttgttttttgttgagagagcggtgggggagaaatgatttagggatgggaggttggtttttcgaggggttttggtgtttgtggagtgggagtgcgggaaggtttttacgttgtgtgtgtcgtgttgggttggttttttatagtttatcgtggtgtttttcgaggattgttggggaggaaagagttaattaatttggggatttagttgttgaagttattattaaatttgagtagtttaggggtttttttttttttgggttttatgttatttagtatagtggggtttaattgaatttttttttattttttaaggtttttggttggcgtggttggggtttgggatacggggagcgagagggtttgggttttttttagatttggagtgggtttattagaaatggtttaggaaatcgcgggggttatttttagtagttgggggtttttgtggttatttttttttggttttgttgagtagttttggtttttggagtttttagtaagggatgtgggggtttgttaggttagggtttttattgttgtcgttatgtatagttgtattttgtattcggggagtggggtgtcgagtggggtgtttgggaggtaggtttttttttgttttttttgtttagagattttggggatgagttgagtgagattttttcggtttttgattggttgtgtttttgttgttattttttattttttttaagtggaggtttatgatttttttttttatttaaaagggttatttagtgatttagtagattttagtttgtgttatttagggtttttttaaaaatttgtggggaggttgggtttggtggtttatatttttaattttagtattttgggaggttgaggcgggtggattatttgaagttaggagttcgagattagtttggttaatatggagaaattttatttttagtaaaaatataaaaaattggttgggtgtggtggtacgtgtttgtaattttagttattcgggaggttgaggtaggagaattatttaaatttaggaggcggaggttgtagtgagtcgagattatattattgtattttagtttggacgatagagtgagattttgttttaaaaaaataaaaataaataaataaaaataaaaatttatggggggatttttgtgtttattggttggtgtgaggagagggtgaggagttgtagagaaggtattaggttgaggatcgtttttatttttgggttatagaattgaaggaggggatatatgaaagatgtttttagattcgggttggaggttggggatattcgagggtaaggacgacgttgtttttgtttttgtttgtagaggagtgtatagggtttattagttttttgttgttgtttaagtgatagttttatggagatagaatttatatattgtgacgttgatttttttaaaatttatagtttaatggttttgttgtatttataaagtgattgtattagggttatttagagaaatagaattaatagaaggtgtgtacgtgtgtttagataaagagatttattattatgaggagttggtttattttattatagaggttggtaagtgttaagattggtagagtaaattagtaggttggagatacgggagagtttatgttgcggttttggtgtttatttgaaggtttaagatttaggagagttaatggcgtcgttttagtttcgagatttaggaaaagcgtatgtgttagtttgagtttgaagtaggaaaaatttgatgttttaggttgaaggcggttaagcgggaagaatttttttttatttaggttttgtgtttttttatttagatttttaggtttttgttataaaattataaagatttgattagaataaaatttgagaaaaaattttttttttttatcggttttggatttattggttgggattttggaaattagattgatagagattaataggaaataagtataataatttaagtaagttttatttgatatcgagtttttataaggaaatgaagatttagagaaatcgttagtttgagcggtttttgttttgttttgagataaagttttattttgtcgtacgtttaggttggagagtagtggttcgattacggtttattgtagttttgattttttgggtttaagttggggtttagttgtcggtttcgggagttgttttgaatttatttttaagttttagtttagatttttaagtagttgggattataggtatgtgttatttcgtttggttaattttttattttttgtagagatagggttttattatgttgttcgggttggttttaaatttttgggttcgagtaatttttttgttttggttttttaaagtgttggggttataggtgtgagttattgtgttcggtttaggtttgaatagtttttatttgttttgtttgttttttaaatttgtttgttgtttgttttgagtagtttttttgtttattttttttgtttgttttttgtttaggttggagtgtagtggtatgatttttgtttattgtaatttttgttttttgggtttaagttatttttatgttttagttttttaagtagttgcgattataggcgtgtgttattatattcggttgatttttgtatttttagtagggatggggttttattatgttggttaggttgttttttaatttttgattttaagtgatttggttattttggttttttaaagtgttgggattgtaggtgtgagttgttgtgtttagtttaggtttgagcgtttttatgttgggtttgatgaagagtggaaagtcgtgggaaattgtgatagagtaataaaagatgagttgaatagtgagttcgtgggggtttcggtaagatttgtgtattggggttttttttagattttttgtttttggagatgaggttgttttttttcgttgggtgtagggagggtattttttacgtgaggggtttatgatttattttagagaaggggtaggttagtgagttttttttggatttgttattttttaaatttttttagttgaaaatatttattatgttaaggtattgtattttggagtgtgcgttttaagttttgttgtttttaattgatcgggtgaggtttatttttattagagtatatagtttgttttatttaggtttttgattgtattttttttttgtttgtttcgagaatatttattagtagtgtttgtggttgtagcgtttattttaagataaatttgtcgggaagtattttgtttttattattatttttatattattttagtatatcgattttggaaataaaagatattattttgtttatagtattttatttttagtagtggtattttttttaaaaaaaaatggtaatttttagttgggtgtggtggtttatgtttgtaattttagtatttgggaaagttgaggtaggttgattatttgaggttaggagttggagattagtttggttaatatggtgaaattttatttttattaaaaatataaaaattagttaggcgtggtggtaggtatttgtaattttagttatttgggaggtcgaggtcggagaattgtttgaattcgggaggtagaggttgtagtgagtcgagatcgcgttattgtattttagtttggacgatagagtaagattttattttaaaaaataaataaataaataaaatttaaaaaaaaatagtaattttcgatcgttgaaaatgttaaattttagagaatatagtatttttataagtgatgttaatattgtttttgattagttgttggttgaagatttatttgatgaatttgatttttttagaatagacgatttagatgattttgttgttttgtttagaaataattgtaggaataatttaaaaaattttttttttttttaatttttttgttttttgagacggattttttttgttgtttaggttggagtgtagtggtacgatttcggtttattgtaatttttgttttttgggtttaagtgattttttagttttagttttttgagtttagttgggattataaggtgtttgttattatacgtggttaattttttgtatttttagtagagacggtgttttattaggttgattaggttagtttcgaatttttgattttaaataattggtttatgtcggttttttaaagcgttgggattataggcgtgagttattacgtttggttagtttttatatttaatttttatatagagtatttagttagatttgttttagttttaaagagcgtgtttatgtaaaattaagtgagtgttggtagtgagttgaattttttaaaaggtaaaagggttaaatattaaatttatttaaaaatatttttatagatatatttagaataatgtttgatcggttatttaggtgttttatagtttagtttagttgatatagaaatttttttttttttttttgagacggagtttcgttttgtcgtttaggttggagtgtagtggcgcgattttggtttattgtaagtttcgttttttaggtttacgttatttttttgttttagtttttcgagtagttgggattataggtgtttattattatattcggttaatttttttttttgtatttttagtagagatggggttttatcgtggttttaattttttgatttcgtgatttattcgttttagttttttaaagtgttgggattataggtatgagttattgcgttcggttgatataggaaattaattattatagttatatagttatcgttattaattttagtatattttattatttttaaaagagattttgtttttattagttaatttttatttttaatttcgggtttttagtttttagttatcgtttatttgttttcgtttttatgaatttatttgttttagatagtttgtataagtggaatcgtatagtatgtggttttggtgtttggttttttttatttggtagaatatttttaaggtttatttatattgtagtaggtgttggtgttttatttttttttatggtcgaataatattttatcgtggatagattatattgtgtatttttttatttgttgatggatatttgggttgtttttgttttttggtataattttgttgtgaagaattttgtagtgagtgttggtttataggtttttgtgtgaatatgtttttattttttttgggtaattgtaagattatgtggtttagttaattagtttttaagttatgtgtttgttgagggatttaggtttggtgggggtgtattgttgtgtttggttagttaggtgttgcgagttcgtgtcgtagttatttttttgtgttgtgttttgaggttgtttcgtcggtatcgggtattgtgagttttaggaggttaaagttttttttgttttattttgagtttaggtttcgttttatgaattaggatgaatggatattgaattaacgtagggatgggtggggttggggtggggacgtagagtgatttcgggggtttgtagttgggttttggttgttgatttttagttttttttgtttgttggagtttagaataagttagaaaggggaaatgtaaagttcgagtgttttttttgtggtagattggtaggtttgggtgggtgagttatttgtagttagttgtagcgtgagagaggaagtgggaggggagggagagggtgagtttggtgtaatttatttttggaaggaggttgggttgaggttgggggaagtgatttttatttttttgagaggatttttttttggggttaattttaaattaagggagataagatttttttgggggaggttggaagtgttggggtttttaggtgggtaggttttttagggttaacgttttggggaagttataagttattatgtttttggattgttatatatatatatatatatatatatatatatatatatatatatatatatatacgagtaaattgtaatataaatgtgtgtttatgaaagtgtttattttaaattattatatagtttgtaaagcgaaggttttggttcgtatttgggtatttattgtttagttagtcggtaggtagtttgtattgtagtttgttattattttttagagatgtagtcgaggagtttagttggtttggagggtttagtgggcgtagttttaggaaagtggttaggttcgggttaggtttttttttttttttagttttgggagaaattattatatgaatgtagttttttttcggagttcgggttggaagggtttgggaggggataggtttttattttaggagtttttaggtttcggttgttgtttgtgttagttgcgtgagcgtgagcgagttaggggttattattgggtggaaggaagaagcgggtattttttttaggaggttatcgttggagttttatagtaggttaattttaggttttgggttttcgggaggaggagaaagaagagaagtaggaggtgtggagggtaggttaggattagaaggtatatagggtcggggtagtgtgggagattttgggggtttttttatttaattagttaatattatagcgtttataagaatacgttattattgtagttttattattttgttttgattttagaaggtataattgatgattttagggaacggagaatttgaggaaggtttcgtaggagagggttagatgcgatcgagtaaatgtgagtcgtttgtaaattgtagagtgtacgtatagtatcggttagttttggggttagtgtttttttggtgtttagttcggtttttgtattttttagtgttcggttgggttttgtgggggttagggttgggtttggtatattagaggatttttattaagtttttggtagtgttttagttattaaatttagtttgttagttattaaattcgttttgtcggttttcgaattattttttcgttggggtcggttatgttacgttaggttttttatgtaggacggtagatggatagacgttgggattaagttatttttgggtcgcgagacgtttgattttttgttggtgttttagaagatgttagtttttcgtggtatgttttttacgcggtgtttggggattagtggtttttaaggggtttttttgttttagcgtggggagtggtttggttaaggttttagtgtttggttggagttaggtataggtttaggtgtattggttggaggttttttgtttatgggttttgtttgttttgtgtttttggtttttattgtgttttttgtgtttttgggagagattttaggggttttgagtttagtattggggttggggagtgggcggggaagagggtggggattagggtttttggttgtagaatagttaggttttaagtttttattttattttttttttatcgggcgttttattttatattgattattttttgaagaaaattttttgaatcggttttttatttcggttgttttaggaagtttatttattttttcgttttaatgttttgtggttttagaaggatggtggaagtcggaaattatgagttttatttataggcggttatatatcgaagtcgcggagacgtcgtgggaaaggattttggttagcgcggtcggtatagagggagcggtgttatcggggtagacgggaatcgtggttgtttttatgttggtttgggagagacgaggggtcggacgaaaggatagtagattggttatttatttatttatttatttatttatttatagcgttttattgggtgtttcggacgtgtaaggttttgtgggtagtgaatgcgatagattttagatagtaatcggagggttacgtgtgtaagaattgagggatttaggttgggcgtggtgttttaagtttgtaattttagtattttgggaggtagaggcgggcggattacgaggttaggagatcgagattattttggttaatacggtgaaatttcgtttttattaaaaatataaaaaattagtcgggcgtggtggcgggcgtttgtaattttagttatttaggaggttgaggtaggagaatggcgtgaattcgggaggtagagtttgtagtgagtttagatagtgttattgtattttagtttgggcgatagagtgagattttattttaaaaaaaataaaataaaataaaataaaataaaaattgaggaatttagtgtagatgagttatttcgggaaaataagtgggagttttaggaatagtatggggaagggatggtttcggtagggaggatttttgtgggtagttttgttggaagagttgaaaggtagttagagaggttgtgcgtggatggaagttgaagagtaggttaggggcgtgtgttttgttaataaagattttaagtatttattgattaggtataatattatgtgttttataaataaatattttatttgatttttagtatttttatgagatagatgttattattttattttatatgtaagaatattgaggtatagagtggttaagttatttgtttagggttatatagtacgtcggtggtaggtaggattttggagttataggaatttggtatattttaggtgtaatggaaattagttacggttttatagagggaaattattagattagtaaattttatatacgttttttggtgttttgaggaggagggattcggataggggtagttaatggtggtggttgtgagatgtgttgggttaatattgatgagagtttgggatggatgagtggattcggagtaatggaaatggagggtttaggttcggtttttggagatttagttgtaatagttgttggttggagaggttgtttatttagatgggggatggggtgggaggtaggtgagatgagagttttagagtttagtttggggtacggttattgggtttaagatgtttttagatgttggggtttgatagtgatagtggttgtagatatttaggatttagtagagggtttggtatagcggggtttagggatacgtttgtgagttaggttggtatttaagtgtgaatttggataaagaaggtggtattgttggtattgaatgtttaggggttgggtgaagttagttagggagaggggtttttaaggtattaggattgatttcgtgggtgagggcggaggaggagacggtagaggttgagagaatagttagagataggaggaaggttagtagagttatgtatagaagtttggagaagatttgaggaaaggaagggttgggtggtcgttattttttgtagttaggaggtaagggtgatttttgtgtgttttattttttagaggattggtggttttatttggttagaattttaagtttagagatgtatttgagttttatgttatggtgtaggtagtaggagttatggagtaggtttgcggggttacggtttgtttgttgttttttggtgtttttattttgagtttaggggttgtttggatgttttgtgttgtatttttttaggcggtgttttagagaggatgaaagtggttattttaaggtgtgattaggtagcggtttatgtatattgtttttttttggggagagtttgggatggaagggtatgtgtgtgtttttgagattttttgaataggttttatgtatttatttatttattttattatttatttatttatttatttatttatttatttacgtatttatttatttatttatttatttatttatttgttaatttatttatttatttatttatttatttatttatttatttatttatagttatttatttatttatttatttatttatttatttatttatttatttatttatttatttgtttatttatttatttatttatttatttatttatttatttatttatttatttatgtatttatttatttatttatttatttatttatttatttatttatttatttatttatttatttatttatttatttatttatttatttatttatttatttatttatttatttatttatttatttgtttatttatttatttatttatttatttatttatttatttatttatttatttaattatttatttatttatttatttatttattattcgtttatttatttatttatttatttatgtatttatttatttatttatttatttatttatttgtttatttatttatttatttatttatttatttatttatttatttatttatttatttatttatttttttatttatttatttatttatttatttatttatttatttatttatttatttattcgtttatttatttatttacgtatttatttatttatttatttatttatttatttatttatttatttatttgtttatttatttatttatttatttatttatttatttatttatttatttatttatttatttatttatttatttatttatttatttattaatttatttatttatttatttatttatttatttatttatttagttatttatttatttgtttatttattcgttaatttatttatttatttgtttgtttatttatttatttatttatttatttatttgtttatttatttatttatttatttatttatttatatatttatatatttatttatttatttaattatttatttttatttttattttagaaagtatttgaagttgttggggtgtgtatttggaaaatgcgttataagtttttataggtttttttttggtttttttatttttttgattggtttttttttcggatatgtaggattttgagtagtttttttgggaggtgggtgtagtttaggtaggttgtttgtaaagttaggatcgagggagttatatttaaggtattgtgggtttttaaggcgatggtattgtgggtttattgtttttagatttttttaatttttaggtttttgagtaggaggatttttggggtagggtttggagacgggaagagaaaataattttagttttttaatttttgttagtttaggtgggtgttgtatggattgggggtatttggaatagttggtttttttattttttttttttatttttttagtttttttggttataattagatagttgtgtgcgatgttttttttttttttgaaggggttatttagttaggtttttatttatggtttaggaatgtgtttttttttgtttgttttttatttttaagtaggtcgtgtttttagttttttgttgtttttgaagggtttgggtatggggtagtttttgtagtatttttagggttcgagttgatttgtatagtagaagggaattgggggaaagttttttttttatttagtatttggtagggggttattttgttgtattttagagatttttgtttaagttttgttattttagatgattttataagttgggggaggcggagttttagtttttatagtttttgttgttgttttattgttgagttttgttgtgtatttgttgataggtttgttgatagtagaaggggttggagagagggaagttttgggttttgttttttttaatttttgtttaggggatatttttgataagaggaaattttagtttgtgatagatggttagtgtttatttatttacgggggaatttttttttttttttgtaagtttgtagatttgttaggaattaaaggaatttttggttgataggttattgtggatatggttggagggttggtacgggttggattttggggttgttttgaggtaggggtcgtttttgttggaaggttttttggggtggggaaggtattagggttattttttgattttttttttgtagtggatttattttagagtttgagataaggtaagggggtagtagaaaatagaatataaaatagttttttttattatatatcgtattagaagttagaggatttatttttggtttgttttttttgtagtttaagttttgagagtggttttttaggaagtgaatggtgatggtttgtaggttagagtttgttttggtttaagattgatgttttaataggtcgcggagtttgggtgaaaaaatttaggttagggaggtggtgggttgtaaatgaaagaatagaggagggttttttttagaaagcggcgggtggtgtgaggagtttttggattttgtttaaatttgattttatcgattggggttaattgaaatcgtgttggtagaaaggtaaaattgtttgagatttttttttttataatagaggagaggtttgtttgaaagggtttggcgagggaaaagttggaggaattttggtcggtagtaaaagtggggattttcgttttttgtttcgggggcgtttcggtttttgaatgaatgaaagaggaggttggatggagatagatttatattatttgttttttttaggttttgtaaaggagtatatagggtttttgttggtttttttattttgttagttattaagaaggagaaaatattaataggggaattgtaaagttgtagttttgtttaagttttatagtggaaatcggaaagagttttagttcggagaaaaatgtagttttttgtttttgtaaattcgtgtttttttttgggaggttagagttattgtgttcgatttttaagtagggttttagagtgttttaggaggggaaggtagagttttagattttcggtattttaggttttaattaggttttgaggagacgttttttgttttatataaagtgtgaagtgtaatttgatttggagttagttaataaattagatgagttgtgtgtattttaaaaatttagtttttgattttttatttatatatatttgtataatttggttatttatatttagtgtttttatttttagaagagaataggaagtttttagtgatatttatggagtgtttgtagtagtttgggtaggttagtaggaatataatgtagtgaaaagtagagttgagatgggaaaatattttgtttttagagttttttagggatgatattttttatcgtttttgtttattcgttttggagtttatttcgtaaatagtaatttgtttttatttgagagtttttttttgtcggagtttagggatggagagtagttggttttagttttttttttttatttttttgttttttagatttattttttattttgaataattgtttttaatttgtttttttttttttttagttgtagaatttagaattttgtgtgtgtggttaaaagtttagagagtgttgtaggtaatgttgagataattttattaaattttgtaagtttttattatattaagtttgtttgttttttttaatttttattttattttattttattttatagggatggggtttcgttacgttgtttaggttggttttgaatttttgggtttaaacgattttttcgtttcggttttttagagtgttaagttatttttttaattgggatttacgggtttagggattttttgatgaatcgtttaaaatacgtgtgtgtttgtttgtttgtttttaatgtatatttttttagggagagtttttattttttattagaggtttgtggtatatatatgttttgtattattgtattagattgtgaattttttatatgttaaagattgttttaaatttgttcggaagtttcggttaataaatatttaaataaatgaattttaaatttttatgtgttattattgtttttattttgattatttttaagtttgtagtgttatttttttgttattgtgaagtagatatttaataaatatttgttaaatgaattaatgttatggttttggtttattaggattttaggattatcgtttattattattgtttatagtttttttattattttgttttagagtagttttttttttgaggtttgtttatttttgtacgtgtgtttagtttttagttttgtcgttttattatttttttttttttatttgtattttttgaattgttaatagttaataatagtttttttttttatttatttatttatatttgaagtgagaagttattattgaggtttttgtggattttgttagtttaatttggggcggttttttggaggtggagtttttagatgagggatggatattttggtgtttgttgggtagatttatttgggagttttggtaggggttttagggtagttttgtttttttattttggttgtgggatttttggtgtattagggttttttaagtaagtatttgtgttttgggagagttataggtaggtttgagagggtttttggaatttgggatttttagttcggtttagtagttggtattattattttttttgtaagggaagttatggaaattaagatgttaatgtgttttgataggtttggggtggttttaagttttgggaagagttttggtaattttttttggttggcgggtagaatttttttttggtagtttagggttttgtttttagttttttgggggagagtaattgagggaggagttggaggttaaggttttagtgttgagttgtttgtatcgtagttgtattttttgggttttggttgtaggaattttatatttttttagtttttttatggttttcgaagatttggtttggggagggggttagtagtttggggtttatttatttggttttaaattttggttttatcgtttattcgttttgcgatttttataattgataaaagttttttcggtttcggtttttttatttgtgaaatgggataataatagtggttattttataggattgtgtgatgatttattagttataatagtttttgagtagcgtttagagtaatatttggggttcggtgtagtggtttatgtttataattttagtattttgggaggttaaggtgggaggatcgtttgaggttaggagtttgaaattagtttgattaatattagtgagatttattttttaaaaaaaaaaattagagtaacgtttggtatagagagtttttagtaaatttcggttgttgtgatgagttttgtttttttatttgtttatttatttattagattttttgtcggggtttgtcgtgagttttacgttgttttgaagaaagtcgggttggggtgagcgtgatggatgaggtgtttggttttataaattttgtgtgggggggttgtggtgagaggaaatcgtatatattattatttagttattatcgtggggagattgtttggacgtagagagtaggttttgtgtgggagcggggagggtaagttttggttgcgaggtagggtttttttaggatttagtagggatttgaaggattttgtaggtatttagggagataggagaggaggagggagtagttttggtcggatattgtttttttagtattgtttgtattagggatttatttagttttaagaagtttttttgtgggggatagggagtatttgttagtttataggatttgaagtgtttttatgggtttaagtttttgggaaggtttgtaggtggtcgtagggttgtcgtaggggtgttggttttagggtttggatttaggggagtttgtagagggagggtagttggaggttgttttagtgtgtattgttacgaggtaaagtaaggagattgttgggtttacgttgggtcggggtggatggaggtaaggaagttttcgtcggggtaagggtattagttgtagatgtcggtagtttttttttggatacgggtttggaaggttgatagggtgtggtgagtgttatcggtttttttgtcgtggtttggttagtggttttataggttttcgtgggtaggaggaggatgattttgtattttgtttggttattattggtagtgatagataaggtgtgtggggatgtggttatttcggttcgtgttttgagagttaggtgtgggttgggtttggggaagataggggaatggtattgatttgattttgagtattttgttttggggtgtaggttcggttgttatttttttggagttgggaatggtattgggcggtggtttagggttttttgttttagcggtattatttttgtatttggttagtaaggttgatgggatttgtgtggatatttttgggacgtagattaggtagtatgatatatagggaggggtaggtagagaagggcggtttttgggttttggtttttaagttaggttttgtaagtttgttgtgttaagttttttttcggtattaggttaggtgggttagggttagttttggggttgtgatgagtgtgagtgtttttaaagtgtgttatgtttaatagttgttttttttttgggtattgttttttagttagatattttatagttttcgttttagttatagatagtaatttgatttttttattttcggtaggttttggggttggggtaagaatttgttattaagtgtagatgtttttagagggtgttggtttagggttgcgtggattatagtttttttatttttgttttagatttatttgtaattttggagaaaagatggtttagtggacgtttgcggggaggagggagttggtttttaggatgagtagatttgggggtagtttttattacgggatcggtgatttattgttattagcgttagtgaatggtagaggggttttggtataaggtttgggtttagaatgggaatttgtagagaaattgttaaggtttttcgttatttgatattttcgtttggttgttattttagaaatatttttgttgtaagaagatgggggagtttgtttggggtatggtttggcgatattaatttgagaattttaggtttaagtgttggtttttgggttttagttgttttttgagttgtaaagttggtttttgggtatttgtggaaaatattggattttttattttattttattttatattttgggatatatgtgtagaacgtgtaggtttgttatataggaatataagtgttatagtggtttgttgtatttattggattttttaatttagttttattagaaatgattgtttttttttttttttttcgttttttttttttttttttttttttttttttttttttttgttttttttttttttttttttttttttttttttttttttttttcgtttttatggggatataatttttatattatattattcgtcgatttagaaagtatagttgagtggtatttttttataattttttataagtattatttttaattttagaacgttttttttattttaaaaggaaacgttattttcggtatatagttatttttttttttttagtttttggaaattattaatttgcgttttgtttttatagatgtatttattttgaatatatgattagaattttaaaagatgtgattttttgtgtttggttttttgtagttggaatgtttttagagtttatttgtgttggcgtacgttcgtgtttttttatggttgagaaatagttcgttgtgttgatttagtacgttgggtttttttacgtatttgttggcggatgtgttagttatttttggagtcgggtgtgttgtgttatttacgggttgtattaggagttggggatattattgagtaagttatagtttcgggtatttaggagttcgtagagtaggagttgggagggaggttaggaggtgtatggtttgtttgttaggttggagagatttgtaaaaagttattttgagttagaaattagagtttgaggtttttgatttttagttgcggagtcgggagggaagttttgtattttgttttgattgtggggtgacgtgttagttattgtttaaattagaatttttttgagagtcgacgtgggtattgttgataattagtttggatattcgaaagaatggaaagtagggatttagatagatttttgtataatcgtgttcgtagtagggcgaggtttggaggtgcgatggggattttaacggggtagttgtcgttttgttggagtttacggtttttggggggggttataggtgttaatcgtatattatataagtaggagtgtgaaattttagggttgttaaatttagtgagggttttgtgttggtttggttatttatagtggtattttaggaaaaaaaattattttatggattttagtttttttattagtaaagagtaggttggattggaattttgtattatttagtatagttgttatttatgaaatgtggttatttaaatttaaataaaaatagaaatttcgttttttagttggattagtttagtgttaagtgtttagaagttatttgtgaatatattgtggtaattttttaaaaaacgaaaattagaattatcgtagtattttataattttatttttgggtgtggatttaaaagaatgtatagtattttaaagagttagagatatttgtatatttatatttatagcggttttgtttatagtagttagcgggtagaaataattcgaatgttcgcggttaaatgaatggagaaattaaaggcgggataggtcgggcgtggtggtttacgtttgtaattttagtattttgggaggtcgaggcgggtggattatttgaggttataagtttaagattagtttgattagtatggagaaatttcgtttttattaaaataaaattagtcgggtatggtggcgggtgtttgtaattttagttatttgagaggttgaggtaggagaattgtttgaatttggggaggtagaggtttcggtgagtcgagatcgcgttattgtattttagtttgggtaataagagtaaaattttgtttaaaaaaaaaaaaaaaaagggtggaatatataaggaatttgatttagtcgtaaagaggaagttaggatatttgtaatagtaagggtgaatttttcgggtattacgttaagtgaaataatttggttataaaaggataattttgtaggattttatttatattaggttcgtagagtagttagatttagaaaaatagtagaatggaggttgttagaggtttgggggatggggttggggagttgtttaatgaggatagtttgttttataagatgaaaaagttttggagatttgttatataataatgcgaatgtatttaatattattggattgtatattttaaaatagtgatcgtggtaaacgttatgataattaaaaggaaaagttacgtggttagtggttattacgttgagtagcgtaggtttcggacggtgtcgtggttatagataatggagtgggtgatttttattattgtttttagttgtttgagtattatggtgttttggggttaggatgaaagtgtttttgggtatgggggtttttgttttttttatttgggagttttgaaggtagattttaaagtttatttggttaggtaggagagcgaggcgggtttttgtattgttttttgcgtgcgtgtttgtttgcgggttagtcggggtttgtaaggtcgtttttcgagggaggggttgtaggaatggtttttatttgtgtagaaggtaagttattgttttacgttaatggtaaagatggggttcggttgcgttgtattattattttttaagcggggtttttggtgggtaggatgtttggtttgatttgagtttttgtagtgagtgttggtgtttgtggagggatttagttgtagttgagtcggtttttttttcgttttgggttttaggggcgttgggggcgagaaaggagagtttagggggtagcgtttttttttaggttttgttggggagggttgagggatgttggggggaggtgggggcgggtaggggttggttttagttttaggtaaaatggtttttagatttataggtagatggaagcgattttcggttacgtgggtggggattgaattgttgtttcgtaaggtaaggttttatgtttggttttaggaagcggttttaaagttatatggtttatggttagatgtagggttgtgtttttgtttatttaaaggttttggaagtttaggggagagtatttttgaagggggagtaggagtaggagtaaagttttgaaggtttttaggttgcgtggtttgggtgggggttacgtgggggtatagagagaggagttttggtttttaggttcgtttgtgggtattgtttttagtagtggagatgtgtggatttttttttggtattttttaataaggaattatattgtttttttgtttttttaattttataagataggaatttttgtgttttgtggaggttgagaagacggggaggtgtttgtgaggataaattagtttttagtttttggtttttagagttttttttttttttatttttgatgttttaggtttggggagttttttttcgatattttttgatcgttttagtgaaataggtcgagagggatggtttgaatcggttggggatgtaggttgtagttagggggtttagtgggtattttttgagttcggtttttgtttcgtaagtggaagggtagttgaattgaagttttttattgttttttttggtttggaagtttgttttttattttttgggtagagtgaggagtgggcgtgggtcgggagggttgttttttgtttgggagggttgtttatttgtttgttacgggggatgagttttttgtagtttttcgtgttgtggttttggtttttacgtcggttttatttttttgtggttgtttttgttgggtgtttatcggttttagggaaaagttatttttttttcggaggattggcgggaggggttttgtttgggagcgtgtcgtgtggtttttgttttagcgtaggatgtttgaggttagattttttttgggaggtaggatggggtaaaagttttttcgtaggtagagtagggtttggatgggtttaagtagggacgggggtatagaatagtagtcgtttagtttgcgtgggagttgagggttattaagggtagttttagtttgtggggattagtagaggtattatttttgtgattagcgagttgtttgtatttgtatgcgtatgtattagtgagtgtggcgagtttgaggtgtgttgggatttggttcgtgtattagttagttttgatgggaattagttttattttgggtatttttggaattttattgtgtgggagtatttgggtttttagtaggcgtttttcgggcgttcgtttttagttttaggtttttgattcgtgtgtggtgttttaatagtagttaggagtagggttatcgaagggatttatagatagaagaggttttagtgatttcgggaagtttagttttacgtgttttatatatttaagagtaaaatttggttttggtttgtgggtgtgtagttcgtgggcgttggttaggtatataagacggtcgtttgggttagtttagggggaggtagatgtggtgtaggggttttttttttttatgagtttaggaatagttttgtatttaggtattcgttttgtatttagtattttttttttttttaggattgttggttcgttttatgggattgaatatataattttatggggatcgacgttggttttattttttttttttataagattatttatggggatgtgggaggcggggatatacgttggttttattttcgttttttataagattattttttttgtgttttggttcgtggatcggtttttaaggtttttgagtggtagtaggcggtatagtttatttgagtagaggtgaaggagagggttaggtttatttgggtggttcgaggtagtgtggagggttaggagaggagagtattttttatttttgtttgagtagttttttagggtacggagataggagtttagggttagttttgttttggagcgtagggggtttttagtttggtatagtttttagaagaggagatgaaaaagtttggttttgggagtttggggatggagttttgttggggaggtagcgtggttgtaggatggtagttttttagaggatattacggttagggatatttattcgggggaatttttaggggtcgtttgggtaagtcgtttagtttttttgagttttagtgttttagtttttttatttaaggatgggtgtgataattatttggtaggcgtttgtgtgtgagtttttgtttcgttttaatttttttgttgttttttttttagttattgaggcggtttttagttgcgttggcgatatggtcgatatttttagagatgtcgggtttaagtaggcgtttgtattacggaacgagaaggtttcggtggatttcggttacgtggggattgattttattttggagtagatgcgtcggaaggttatgaagtagggtttcgagtttaatattatggtggtcggtgagtttttattttgtatgttatttaattaatgtcggaaattagttttagtttttagggcggtttataagtttttgggtttggtttttttttttgtaaaatggggtagtaattttgattttaaggacggattgttagtgatattgcgtgtgtatgtatgcgtttgggaggagtttatagtttttagcggttttttagaggggtttgttttgtatatttagggtttttgagatgattttggggagtttaggtcggtttggagtaggttttgatgagtggtcgttgtttttgagtaatgacgttagtttgtgtagagggttttgtggtagttgtttttttattgttgttttagtttggttttttaggttttttatcgtattttatcgtatttcggttagaggttttttagtagtttagttttagttttgttttggaattggggtttcgtggtttttatattttttggtggtttcggagagttggaggttattacgggaggtcgtcgattagtacgatttgggtagggtgagggggttaggttggagtttatagtgggtcgtttgttgtttttaaagttttttaggttttatttaaattttatagggattttgtgaagggggcgtttcgttttttaggtagaagcgaggtttagggaaggttgttaaggttttttagtttatagggtagagaatcgtagttatcgttttgatttttagaattgtgttttgtttattttacggggtttagggaggggtttggggaagtgttttcgttaggttatattttaaataaaggtgagtttgcggggtttttgtaaggtgtttgggtattttttaggtcgggtttgtttttttgatttttgttagtcgtgtacgttttttttgtttagttttgtggacgtaaatttatatttgttagttcgatatttttttttttttttttgtattgatttgggttttggtttttttggggttttggtgttttttttgttttttgtagttttatgggattcggttgtttatggttttgttgtgtttatagttgtttggaagttggtagtttgttttaagggagggcggaggtgtggggtttttttttacggtttttattttgttttgtttgttgtgggggacgtgtttgtattttgaggatttagggttgtttttcgggaagatggttggagagaaagagaggggagaggtttaaaggtagtggttaggttgggatttatttttgtgggttacggaggggttgttttgttttttagttagggatagggtgagaaggatttgggaatttttgcgttttagttatggtataggttttttttcggagttttggttttaaggagagggagaggtagtttagtagttttcgtttttcgtggttgttattgtgatagttttgttttttgggaatggtgcgtaggaggttattttatttgtttgggttttttcgtttttttaattttgagaagaatagtggttttgattttttataaaattatttttttttagggatgtcgagtgaggaataagacgtggggtagttttgtttttttttttttttttttttatggtagttgtgtttatttgtagaggtgtaggtaaggtggaggggtatttgtttggaggtttatagatttcggggagaattttagttttgttttaatttagcggggtgaggtttgtgtgtttttttttgggttttttttttgtgagttttagttttttcgtttataaaatgggattattttataaagtgagattaagcgagttaggtttcgggtagggtttttaataggttgtggttgttcgagaatttgtagtagtggtgatggtggttgtggtgatgaggatgatgggggtggtaatgacggtgatgatgatggggtgatggtgttagtggagatgatggggatgatggtgatggtggtggtgatagtggtgggatggtagtggtgatgtgggtgatggtgattgtgatggtggtggtggtggtgatggaggtgatggtgatagtgattatgagggtgatggggatggtggtggtggtgatggtgatagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgttggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgttggtgttgatgattgtgatgatagtggtggtggtgatgagggtgacggaagtggtgatgatggcgggagtgatgggatgatggtaatagtagtgatggtattgtgatgatggtgttgatggggatggtggtgatgataagggtgatgatgatggtgatgataataataaaagtaataataataaagggatatattttgtagtattttagttggtattttttagatttaaggtgtcgtggttggaatattgatataatttttgatttgaggttggttaggatatagatttggtggatagagagagatggacgaggagtgttcgtttttgggttattaaatagtttaggttagggatttttagtattagtttttgtttttttaggagtttatattttttttagaaaggtgttattaaagttagaatattagtgtaatttagggtgttttttgtgttgtgtttttttgagatagggttttattgttgtttaggttggagtgtagtggtatggttttgatttattgtagtttttatattttgggtttaagtgattttcgtgttttaggtatgtgttattatatttggttaatttttgtgttttttggtagagatagggttttattatgttggttaagttggtttcgaatttttgattttaagtaatttattttttttagttttttaaagtgttgggattataggcgtgagttatttcgtttggtcgatttttgtttttttaaaagatagggtttttgttattttggagtggtaatgattttagtttattgtagtttcgtatttttgggtttgagtaatttttttattttagttttttgcgtagttgggattataggtgttcgttattatatttagttaatgtttatattttgatgtagagatagggtttttttgtgttgtttaggttggttttgaatttttgggtttaagtaatttttttgttttagttttttaaagtgttgggattataggtatgagttattatatttggtttagggtattttttttggtgtgttgttagcgtagtttaaggtagttttgtgtagggtaaagtaatggggtttcgagtttggaggggtgtgtgtgtgtgtgtgtgtgtgtgtgtgtgtgtgcgcgtacgcgcgcgcgtgttatatgtgatttgtttgtgtgtgttgtgagagttgtgtgtgaggtatgtgtaagaggtatgtttgaggtgagttgtgtgtgtgttgtgagttgtgtatgtgaagtgtgtgtgttgtgaggtgtgtgtatgaggtgtatgtgagttgtgtgtgttgtgttgtatatgaatgttatttttttattttcgtttgttttagttatttgtggattggttgtttgtatatacggttattgtttttcgagtggtattattttgtaggttagcgttttttagtatatggttttatagattttatgggatatgcgtgagtttgtttgatgtttatattagttttacgggggaaggattgtttattttattttgtagattaggaaattgagatacggtgaggttaggtgatttgtttaggttttggtcggttagggaggagtagtttgaatatttgggttttggttgtaattattttggtgaattgtaggaatttcggttatttggtgtattttgggtagttttgggttttttcgttagttcggtttttgttttgtttaaaatttgagttattaggagattttttgtttagaaagtataaggggtataagagatgtcgatttttttaggttcggtttattttttaggagaggattgtggtttgggttgtgttggtattagagttcggttgtgtgggtttatatagttattggatattcggttcgagggtgaagttttcgggggttgtttggtagggatattgtcgggaggtagtttaggtattgttgaattttagattggagagtttcgtgtttgggtgggaggggttttatgtgtagattttgttggttttttcggagagatttttgatcggttttttattttttttttagggtagagcggtttgggtaaatttattttaattaatattttttttaaatttaaaattagtcggaagtcggtgtagtttattttagaggagcgtatttttaagattatcgagattaagtttattacgtacggttagtggtcgggagtgggttgggggtgtaggacgtttttgtttttttggagtataggggttgggggttaagattattatatatagttagtggttaggggcgggttgggggtgtaggatttttttgtttttttggagtatagagtggggggttaagattattatatatagttagtggtcgggagtgggttggggatgtaggacgtttttgtttttttggagtataggggttgggggttaagattattatatacggttagtggttggggatgggttggggatgtgggatatttatgtttttttggagtattggtgcggtgtgagggtgttcgagttaggtaattttaggtttttaagacggggattcgttgtgtttattatttttagtatgttgagtatgttggggttttggttgtgatgggttagtgtttcggatttttgtgggtttcgttatattgagttttttatagataattgagttttttattaaaagtttgataggtaaggggtttttaggggaatcgttatcggtttgtgtcggagttggttgaggaaggttattaatttttcggtgtttttttggttgttatcgttgtttatttggggttgtttcggggttagttaggtgtggggtgtttgtgagggtttttcgttttttttttgattttgcgttcgtggttttgtgtagatattgaggagaaaggcgttcggatgaagttgatagtgattgatatattagggttcggggattatattaataacgagaattggtgaggtttttttagggggaggagtattagcgggggttttagggttttttggattttatttagagttagttttagaggtttttcggttcgcgggggtgtagggtttattttttgggatttgatatgttgttaaagtcgtacgttttaggggtttgaaaattttggattaaagtagaattatttggggaattttgttgtttttaatttattatttgaggttagttcggggaggttggtttgggaggtcgagggtaaggttgtggtattttcgtttagtaagttagattttttagggtatgtattttattggaaggtggggtgttgggttttgagttttgggaatgtacgatttgtttggggagggtattttatgtgtttgttgattcgtttttattttttacgtagttggtagtttattatgaagtttattaatgattagtacgagaaatatttgtaggaggaggttaatattaatcgtaagaagcgtatttcggatattcgcgtttattgttgtttttattttattttcgttatcggttattcgtacgtttttgtagtgtcggcgtttttatgtcgggtgttttgggttttttttgttttttgggattgtaagacggtgttgtttgttttgttgttgggtgtagaggggttgagttaggggttatggtcgttagttatgaagttgggggtgtgttatgtttgtatttttaaagttttatattgatttttatgtaagtgttttgtttagtttttattttttagttgcgttttggggagttgagggttaggtaggttttgggttgttttggagtttggtggtttgtgttttgtttttttaggttaggttttggtaggtggagtgggagtttttagttaagtattcgtagcggtgattgatttttttattcgggttttgttttatgggattttttagagggtttggtgcgtttttagacgggaagtatagagattagtgttggttttttttagggttggacggggttgttgttggtgttggtgagagtttttttttttcgtcggttttgttcgtatttgacgtcgtttttagagattagtaagggcgggaggttgtatgtattttggtaggtggattttttatggttttacggattttttgtttttagttttttgtgtattttttgttagatatttgtggtttattttgagttagggttgggaggaggaggattagaggttagtaggagtggttggtggaggtagtcgtgggtggtttgtttgtatgggtgggtggagaaggtttttcgtatttgttgttttagatgtatttttttgggcggaggaagtttaggggtttggggaaattatattttgtgggtattaggtgtaggaaggagtttggttggtgggtagcgggttttatttagagtttgtgggaaaatttaagtcggagttttcgagtttattttttggtattattttttgtgggttagtaggagttaggggtagggggttagttcgttgtttatgggttttttttgaattgaatatttgtttttttaggtagaacggtttatttgcggttttgtggtagttgttttagttgttttaagttttgttttagttgaggttgatggtaggaggtagaagttttttttgatgttagttgggtaagtcgagggcgggcgggcggtttgtggtatttttgttattttttagtattgattttttggttgggattttagttaggtatgttgtttggtttcgtttaaggcgtttagttttatggggtaggggcgggttttggttatttttgtttaaatttttgttcggagcgggtttttttttagttatgtgtgtgatcgatttatttttattgtgggaaaagttcggttttagaattggggaagatggtgttttagttttagggttttgttagtttttgttatttatagttttttttatattagattttaggtttattggggttaagtaggtaaggggagtagttcgtttggtgtaggggagtagttcgtttggtgtaggggtatcgtatattggtgttagtttttattttttttgtttttttttttttagttaaagttttatagtaagacggttgttgagttaacgatagtttttttgtgtggatatgtaggggtgtggttgggattttagaatttatggacgagggtgtttggagttggttttggttcgtttggtttgtgtagtggtgttatttgtgtttgggatatattcgtgttttttttttgttttatatttatagcgtggtcgattcggttcggggttttgtttttgttagtagggattttcgtgagtttcgagttagtatttgagagtgtcgatatttgtttgggggtgggtgtttttttattgtttcgtttttttagatgagttttacgtatatttttttgttttagttttaggtttttggatatcgagtttatgaaacgtttgagtaaggtggttaatatcgtttttgttatcgttaaggcggatatatttattttggaggagagggtttattttaaatagcgggtagggttttatttttatttgttttagtttttttgtgtaatttggagacgttgtaggtttggtaggggttatttcgtttaaaggagttatattgttagggagatcgaatcgttggttattttttttagcgggtggttggtttggtggtttttggtttaggtggttgttgggggtcgtttttgagatggtttttttagtttttttatattttaaaagtagttttgtgggagtgttaattttttagtagagtttttgaggggggttttggagaagatttggattaggtagatggtgaattttttttttagggagtgaggtcgagtaggggtcgtgcgatatggtttattttgttttatgttttttttttttttttttgagaaagggtttggtttagttgttaaggttgtaatgtagtggtataattatggtttattgtagtttttattttttaggtttagttttcgagtagttggaattatagacgtatattattatgtttggttaatttttgtatttttagtagagacgaggttttgttatgttgtttaggttggtttttaatttttgggtttaagggatttttttgttttagttttttaaagtgttggggttataggtatgagttattttatttcgttttgtttggtttttattagatggaagagaagttgggttaggtgtggtggtttacgtttgtaattttagtattttgggaggtcgaggcgggtagattatttgaggttaggagtttgaggttaatatgatgaaattttatttttattaaaaatataaaaatattagtcgggtatggtggcgggcgtttgtagttttagttatttgggaggttgaggtaggagaattttttgaattcgggaggcggaggttttagtgagtcgagattgagttattgtattttagtttgggtgatagagcgagattttattttaaaaaaaaaaaaaaaaaaaaaagttttaggagggatggtttttgttattttttttttcgttatcgtttgaggtttttgttgtgggatagggaggggtatttaagtaagagggtagttttgggtttttttttttgatagggtagtatattagagttatatggggtgttttttaaaatgaaatcgaggtgtttgggttgcggtattatatttgtttcggtgggtgtgggtggggtttgtaatttatttcgttttggggttaggtgttagggatttttttagtatgtgtaggggaagatagtttatataaagtgggtgtgtttgtcggaggttatatacgggttgtggtttgtgtttgggtaggcgagtagtcgtttattgggatgtttttgttgtacgtatttatgtcgggttgttggtagggagttgagaggttattgtaggcggggtttttgttggaattggggattgtgacgagggttttttaggaagggttttaggaggggaggtttcggtaattttgagtatttttttggggttgtgatgagtaggagaagagaggtgggaggtgtttaggacgatgattttaagtttttggggagttgtagcgtcgtttaggatagtaggtgtatttgtagttgttttttttttttttaggaggtataggagttggaggtgattggtgttatagttttttagagtttgtttttgaattcgagtttggggtagtatatagtgtggaggttatgtggtaaatattagtgggtgggtagagtttgttatagggatgggtttatttttttttttttttattttagattatcgtagatttgttgtttaacggtatcgacgtgtatttttagaaggaatttgatgaggattcggaggatcggttggtgaacgagaagtttcgggtgagtggatttattaggatgttgtttttaggggatttttagtttttgttgaagggtgggttgggggtttggaggattttaagttatgaaattatatttttggggttagagggtattgagtttaggtgtttgtatttagtgttgttaggttgaggttttcgtttttgggggattttaggtttagggtagtttttttcgggggtttaggggagggaattgttttttcgtatatgtgtaattaatatcgtttgttcgttttttaggagatgattttatttgttgtggtgggtagtgattacgagtattaggttaacggtaagaggatttttgggaggaagattaagtggggtattatcgaaggtattcgtcgtaggcgtcggggttttagatagatgggaagatagttttttttgttgatttagagtttgtgggttacgtttgagttagggattcgtggaattttatttattgttttgttttatttagagggaggggtttttttgtttttatttaatttttgggaaagtgagagggtaagtggtttgtgtagatgtttttattttagattttttttcgggtagggaaagatttagggagataggagttgggatgggggtcgttaagttttggattttggtgtaggtttttttataggtatttgtgtggttttggataaatcgtttaatttttttgggtttagaaaaggggtgggttgtagttttgtgagttagatggattttcggttttttattttgttgaagtttttgggatttttatattttagttttttgagtggttgttgtaattaattagtataaacgaggggatttaaaataatataaacgtatttttatagttttagaggttagaggttcgaaattaggggttgtttttttttgaggttttgaggattagttttatttatgtttttttttttttggtggcgtttggtatttttagttgtattgtaaaggtattatatgttttaatttttgttttattgttatagggtttttttttttgtgtttttgtttcgttttttttttttttttttttttttttttttttttgtttgagacggagtttcgttttgttatttaggttggagtgtagtgttgtaattttagtttattgtaatttttgttttttgggtttaagtaatttttttgttttagtttttcgagtatttgggattatagttacgtattatttatttgatttaatttttgtatttttagtagagataggatttcgttatgttggttaggttggttttaaatttttgattttaggtgatttgtttattttgtttggttttttaaagtgttgggattataggaatgagttatcgagtttgtttttttttttttttgtttttggataaggatgtttgtttttggatttagggtttattttaagtggatgattttatttggagatttttaatgaatttataaagaaagacgttttttaagtaaggttataattatgggttttaaggtttggattttgattatgtttttgaatggatgggagtttttggggggttatagtttaatttatttttggcggtgatatttcgggagggatgggttcgaacgttttttttttttttttttttttgtttttttattttttattagaatggaagaggggaaggtgtagagggaaatgtagtaggaaaagttattttgttttgggagagtatttggttgaaaggtttagtagagtaggaagtataagttttttaattttttagggttttagtttttattatttataaagtgggtgtagtgtgttaagattttagtgagttgagagattgttttaaagattatagagttttttgggaagttgttgttttaaaaaaatggttataatgataattattaggaggtattagatatttttgtgttattggttagatatgggttatttcgttttatgttcgaagtttttcgtatttattttttttgtagagttgaagaggtgttgtgagtagaaaatttgttaagggatttagaacgggaggcggttttagaatttatagttttagttttgtattagattttttcgagatgggagtttatgtttggaggagggtgtggagaggtatacgggttttttttttgtttgtattttttttttattattatttttgtcgggtttattttgcgggagttgtttagttgggtgtagtttgggtgttttttagtattcgtttgtggtgttaggttggtttgtttttttttggtttttttgtttgtagtttttttttttttttttgtttaaagagtttttgttgtttaggaaattttttatgaaaggtaggtttgggagagttagggatggatgggtttgggacgggtcggcggttttgttatgggcgtgtttttgttgtattttggtggttaattttgagtatcgtaggtggtcggtgatagaaattgttaggaaatgtataagagagaggttttcgtatttttttgatttgtgcgttgttgagtattattggttttagttgaggaagagtttggaatttgttaggatagttgtgaggtggtggggtttattttttagtagttttatatgaggattttggaaatgtgtttttagtattgttgggtttttatattaggggttttatgagtttatagttgatttgatattcggattagtaagggttgtgttttgtttttgttttttatttggtgaatagtattttgaggtattttttttatttttagaaattattttaagtattgttaatagaaatgtggggtgtaattgattacgttatgaatttatttaatttttatgtttttgagaggcgggtgacgttattatttatattttatggatgaggaaattgagggaatgagagtaatttgttcgagttagggagtggcgattatatattttaattttagtttgagagttttattttttttgtcggttttcgttgttcgttagtgttagatgagagtgttgttggttagtttgtaggaggttttagtgtggatatcgttttatatagggtcgtggtaggagggtttaggtaaaggtaatcggtatagtattgagagtatttgagggttgggtaaggtggaggtttcggttttgtttgttggtttattaagtaaaaattagatatttttaatttggggaaaagttatgtggttttgcgatggggtagtttggagttaggtgtatgggttttgtatttcgttttagttttatgtattgtggagttgagatagatatagtttttgcgttttttatgttttattttttttttttttttttttttttttttttttttttttttttgagacgaagttttatttttttgtttaggttggagtgtcgtggcgtgattttggtttattataatttttattttttgggttttagtgatttttttgttttagttttttgagtagttgggattataggcgtttggtattaggtttggttaatttttgtatttttaatagagacgagattttattatgttggttaggttggtttcgaatttttgatttcgtgatttatttattttagttttttaaagtgttgggattgtagacgtgagtcgtggtgtttagcgtttacgttttattttcgtaagataatggggataataaaggaattataagagatatttgtaggtgtgtgaagacgaagtttattatatgggagggtatcgggtgtttttatttgttttttttgttcggttttttatttttagtgatgtcgtttattgttttttttgttaaaaggttttttgttatataatagttatatatgttaggtatcgcgtgtttatataggagttacgaagtatagtaataaaatgattattttgagatggttattagttcgagttcgagggtatttgtgggtgttcgtggttttttgtttagtttttttgagaagtggttattgtttcgagtttgggtttgtatgtattgtgtgaagtgtatatgtttttgagtaatgtttagtattgttgatttttgagtttgtgaatggtcgtttatagtacgtagtttttgtgtgtgtttttgtgtgtgtgtgttttgagcgtatataaggtggatggggtcgtgggggtaatattttgtgggttataggttttttttaaaattttagtttcgatttttgttttattttatttttagtagtttagttttttgtttgtttttaggtttttgttgggacgttttgttttttttggttattttagtggtgcgggggtttattgttttggtttttttattgtggtttttttttatgtttttatttggtttggttattgtgttattttttattagttaggaattttttggagagtaggagttgagttgtttaggagtaggagttggtgttggttattttagtattttttagattgagggtagtgttaggtgttttatatttagttgtagagtaggtggtttttttgtttttttgtttatggggttgtttttagattttgtttttggtattagtatttttgggtagggggagagaggtggggttcgggtagagtttttttattgggatattaaagttttttttgtttttttttttagttgaaaatattatatattgtgagtttgtttatttgcgggatttttttattaggtgagagatagggtgtttgggtggggttgacggttttatttttaagagggttttatagcgggtgggggtagtgggtgtggggtcgaagttttgggtagagtgggtgttttttgttatttgtttgttttgttttcgggaagattttggaagtttattttttgaaaaagaaaatttattgggaaatgaagtaggtagtgaagattttttttaatttttgcgaagttggttggatgggaaggttgagttttgatttattgtggtttggttcgttagagttgttcggtggttattaagggtttagtgaggttttatgtgtaggttttgtcggtagcgtggggcgtttttagtttcgattttattggtttttgatttttattttttttatttggttgaggtttttttttgttttttttgagtttaggtaaggaggggaagttttgatggagagggtgttgggtgggtggtttttggagtgtgggttttggtttgggtaggtttttttttagtaagtagttggtatggatgatgggaatgttattaagaggaggggtttttaggttggcgggggtaggggtggggggatttcgggagtcgttttgttattgtggggatattgggttttttaatttttttttagattattttttttgagttgtagaggaatgaaaattcgagtttaggattttttttttttggggataagggtaatttagttttttgttttaggttatttgtttgttataggttatagttttggaggtcggtggttatttattgtttttattttgttagtattttggatatcggtttggagtaataatgttttagttttgtttttttgagtttatgtattgtttttgggttttggatttagggttatagggtggatttagagggagatatatgtattggaatatgtgtgttttgatcgagtttgggtttattagggggattgattttttttttaaaacgtgtattagatttggtttaatatggtgggtttgggggattttatggggagttaagtagtcgggatggggagtgggggtgggggtaggcgggtttgagttcgaggtaggtcgagtagggtttttgtttcgttgtttttatttcgttgcgtttattttattgattcgttcgttttttatttttataggacgtatatgtagaatattaaggatattattagtagtatttatttcgaggcgtatcgtgtgaagcgttttaacgagggtagtagcgttatggttaacggtatggaggagaaggagttagaagtttcggagatgtagacgttattttgtttattttcgggattttgtttttaagttattttcgtttttttttaggtttttttattattttattttattttatatgattttttttatttgttatcgttttttattttttcgatatgttgttaggaaataagggaaggggttttttttcgagtgagttagtgatgaggtcgcggttttttcgaggttgtggggaggttgtattggagttataggtaggggtgagagtatttattgaattgatatgattttttgtttttaggtttggtttttcgagggtttagaagagtagtttcggtgtgtagattattcgtttgtgtggggtttttagtgtcggaggttttggggtgggggttaggtttcgtatttgtagaggagtttagtgggttgtacgtttttttttatttttatcggttttgttttttggagtgtgttagagtttaggggagaatgtagtttattaggagtatttggattttttgttcgttatatggtgtggttattatttagtttttatttttgttttgtttttaagggtagaaaattttagggttttttgttatcgattgtttagttattttaagttttttggtagttgttttttttggagtagaaagtgtttttattttagttattcgtagattgtttggttagatgcggggataggttggaatgagggaggcgtttttatttttttgttattttttttttacgttattttcgtttttatcgggttgtaggtgttgttgatgcgttgggatttgattgaggataaaaaggaaggagagatgatttttatttttttattttttagttttgaaaaggtttaagtaagtgagtttggtggaggagttgagggagggagttatggaaggtgttagaaggaaggttggcgggggtacgtgtgggtcgtggtttgggttggttagagtggcgtgagttgttcggcgtttgttttgtttaagtgattagggaagtgtgtgtgtgtttatgtgtatgcgtgttcgtttgtttgtttagtgtttgggtttggtttaagattgggttgtagttatattaatgtttagttagttatttttgttatttattttttttggtttaggttttgttgattttttgagttggggaggtgggaggttaggcgagtttgattttgttgatttattcgtgtttgggtttttttttttagagtttatggtaacgaatttttagaaaggagagaacgggcgttaggggtgtatagtttatagttgaagagtaaggtttcgtggtagtacggttcggttttttattttttgtttttacgaggggatttatgggggttgtttttgtagggtatagatgattaaagtttttttttgttttttgttatttgttttgtttttggggagaaagaggggtttgatgagattttatttaggtgtatatattattaggtgtatttgtaggtatcgggttggttgtttgtagttaggagaaggttagcgagaaggagtgtatgagtgtgagtgtgtgtgtatggaagttggggtattgggcgtttgattttttttttatttaagagaggaaggattttttattatttttattggtgagatagtttattttgttaatttgttatgtttttgttaaaattaagattttgaaggaaatgagtggttagcgttagggtttaggttatgtggtttgtttagttttaatgttatttggtggcggggtggggtgggggtgggtagtagtattttagttttgagatgttttattttttttttttgtaattagattttgaaaaattgttcgttttattaggttttgttttttaatggttttttgttacgtgtttttcgagaaatttgtttttttgtataaatgataaagtgttgaaaatgtattttttgaaataaatgttttaaatgtagaaattta

SEQ ID NO: 5 - DNA, 219909 bp, Artificial Sequence
  source 1..219909: /mol_type="DNA" /note="chemically treated genomic DNA (Homo sapiens)" /organism="Artificial Sequence"
tgggtttttgtatttgaaatatttattttaggaaatatatttttaatattttgttatttatataaaaagataaatttttcgggaggtacgtagtaaaaggttattgaggaatagagtttgatgaaacgaataattttttaaagtttggttatagagaaggaaagtgaagtattttaaggttgggatgttgttgtttatttttattttatttcgttattaagtgatattgaggttgggtaggttatatggtttgggttttggcgttggttatttattttttttaaaattttggttttggtaaaaatatggtaagttggtaaagtaaattgttttattagtgggggtggtgaggggtttttttttttttgggtggggagggagttagacgtttagtgttttaatttttatgtatatatatttatatttatatattttttttcgttgatttttttttggttgtaagtagttagttcggtgtttgtagatgtatttggtgatgtgtgtatttgagtggagttttattaggtttttttttttttttaggagtaagataggtaataggaagtaggaagggattttggttatttgtgttttgtaaagatagtttttatgggttttttcgtggggatagagggtgaggggtcgggtcgtgttgttacgaaattttgttttttagttgtggattgtgtatttttgacgttcgtttttttttttttaggggttcgttattatgggttttgaggggaggggtttaggtacgggtagattaatagagttaggttcgtttggttttttatttttttagtttagagagttagtaaggtttgggttaggaagggtgagtggtaggggtggttggttgggtattaatgtaattatagtttagttttgggttaaatttagatattagatagatagacggatacgtatatatatggatatatatatatttttttggttatttgggtagggtaggcgtcgggtagtttacgttattttgattagtttaagttacggtttatacgtgttttcgttaattttttttttggtattttttatggtttttttttttagtttttttattagatttatttgtttagatttttttaaaattgggggatgagggggtaggggttattttttttttttttttatttttaattagattttagcgtattagtagtatttgtagttcggtgggggcgggggtggcgtgagagggggatggtagggagatgaagacgttttttttattttagtttgttttcgtatttggttaagtagtttgcggatggttgagataaaggtattttttgttttaggaggggtagttgttagggggtttggagtggttgggtagtcggtggtaggggattttggagttttttatttttaggagtagggtaggggtaggggttgagtgatggttatattatgtggcgggtagggggtttaggtgtttttggtgggttgtatttttttttgggttttgatatattttaggggatagggtcgatggggatggaggggagcgtgtagtttattgggtttttttgtaagtgcgaggtttggtttttattttaaggttttcggtattgagaattttatatagacggatgatttgtatatcgaagttgtttttttgagttttcggggagttaggtttggggatagagggttatgttaatttagtgggtgtttttatttttgtttgtggttttagtgtagtttttttataatttcggggaggtcgcggttttattattgatttattcggagggaggtttttttttttgttttttggtagtatgtcgaaggggtggggaacgatgataaatggagaaaattatataaaataaaatggggtggtgggagggtttggggggggacggaaatgatttgggggtaggatttcgggggtgggtagggtggcgtttatattttcggggtttttggtttttttttttttatgtcgttggttatggcgttgttgttttcgttgaggcgttttatacggtacgtttcgaagtggatgttgttggtgatgtttttgatgttttgtatgtgcgttttgtgggggtggggggcgggcgggttagtgaggtgggcgtagcggggtgggggtagcggggtaggggttttgttcggtttgtttcggatttaggttcgtttgtttttatttttattttttatttcgattgtttggttttttatggggttttttaggtttattatgttggattagatttggtatacgttttgggggaagggttagtttttttggtaagtttagattcggttagaatatatatattttagtgtatgtgtttttttttgggtttattttatggttttgggtttagggtttagggatagtgtatagatttagagggatagggttggagtattgttgttttaggtcggtgtttagggtgttggtagggtggaagtagtgggtgattatcggtttttaggattatggtttgtggtaggtaggtggtttggggtaaagggttgggttgtttttgtttttaggaaaaaaaagttttgggttcggatttttatttttttgtagtttaggaggaataatttggagggaggttggaaagtttagtatttttataatggtagaacggttttcggaatttttttatttttgttttcgttaatttggaggtttttttttttgataatatttttattatttatgttagttgtttgttgaggaagaatttgtttaggttagggtttatattttagggattatttatttagtattttttttattagggttttttttttttgtttggatttaagggaaataaggagaagttttagttaggtgaaaggggtaggggttagaggttagtgggatcggagttggagacgttttacgttgtcggtagggtttgtatatgaggttttattgggtttttagtggttatcgggtagttttaacgggttagattatagtggattaaagtttagtttttttatttagttaatttcgtaggggttgaaaaggatttttattgtttgttttattttttagtgggtttttttttttagaagatgggtttttaagattttttcgagggtagggtaggtaggtggtagggggtatttattttgtttagggtttcggttttatatttattgtttttattcgttgtagggtttttttaggggtgaagtcgttagttttatttaagtattttgttttttatttgatgagaaggtttcgtaggtaggtaaatttatagtgtgtggtgtttttaattaggagaggagataggaggggttttaatgttttagtggagaaattttgttcggattttatttttttttttttgtttagaaatgttggtgttaaaagtagagtttgagggtagttttatgggtaggagggtaggggaattatttgttttgtagttgagtataggatatttggtattgtttttagtttgggggatattggagtgattagtattagtttttgtttttggatagtttagtttttgttttttagaaagtttttggttaatgggagatggtatagtgattaggttaaataggagtatggaaggaagttatagtggagaagttagggtagtgggttttcgtattattggggtgattagggagagtaggacgttttagtaggggtttgaagataggtagggggttgggttgttgggaatgggatgaagtaggaatcggagttgggattttaaagaaaatttgtggtttatagggtgttatttttacggttttatttattttgtgtgcgtttagagtatatatatatagggatatatataggggttacgtattgtggacgattatttataagtttaagaattagtaatgttaaatattgtttagggatatgtgtattttatataatatatataagtttaagttcgggatagtggttattttttagggagattgggtaggagattacgggtatttataagtgttttcgggttcgagttggtggttattttagagtggttattttattgttgtgtttcgtaatttttatatgaatacgcggtgtttggtatgtgtaattgttatataatagaaggttttttaataaggagggtagtgaacggtattattggaggtggggagtcgggtagggaaggtaaataaagatattcggtgtttttttatgtgatgaatttcgtttttatatatttgtaagtgttttttgtgatttttttgttatttttattattttacgaaaatggggcgtagacgttgggtattacggtttacgtttgtaattttagtattttgggaggttgaggtgggtggattacgaggttaggagttcgagattagtttggttaatatgatgaaatttcgtttttgttaaaaatataaaaattagttaggtttggtattaggcgtttgtaattttagttatttaggaggttgaggtaggagaattattggaatttaggaggtggaggttgtggtgagttaagattacgttacggtattttagtttgggtaaaagagtgaaatttcgttttaaaaaaaaaaaaaaagaaaaagaaaaagaaaagaaaagaaaatgaggtatagagaacgtaagaattgtgtttgttttagttttatagtgtataaggttggagcgggatgtagaatttatatatttggttttaggttgttttatcgtagagttatatggtttttttttaagttaaaaatgtttagtttttatttggtaggttagtaggtagggtcggggtttttattttgtttagtttttaagtgtttttagtgttatgtcggttgtttttgtttaggtttttttgttacggttttgtgtagggcggtgtttatattagaattttttgtagattgattagtagtatttttatttaatattgacgggtagcgagagtcggtaggaagaatggggtttttaggttggagttggagtgtgtgatcgttattttttggttcgggtaagttatttttatttttttagtttttttatttataaaatgtggataataacgttattcgttttttagggatatgaggattaaatgagtttatggcgtgattaattatattttatatttttattgataatatttggggtggtttttaaggatgggaaagatattttaagatgttgtttattaagtgggaggtaagaataaggtatagtttttattagttcgggtgttaggttagttatgaatttatggggtttttgatataaaaatttagtagtgttgaaggtatatttttagggtttttatataagattgttggaaagtgggttttattattttataattgttttgataggttttagatttttttttagttggagttagtggtgtttaataacgtataggttagagaggtgcggggattttttttttgtgtattttttgatagtttttgttatcggttatttgcggtatttaaggttggttattagggtgtagtagaggtacgtttatagtaaagtcgtcggttcgttttaggtttatttatttttaatttttttaaatttgttttttataaaaagttttttaaatagtaagaattttttgggtagagaggaagagaggaattgtaggtagaggggttaaggggaggtaagttagtttgatattataggcggatattggaaaatatttaggttgtatttagttgggtagttttcgtagggtgggttcggtaggggtggtggtaggggaggagtgtagataggggaaaggttcgtgtgtttttttatatttttttttaggtatgaatttttatttcgagggagtttggtgtagggttggagttgtagattttagagtcgtttttcgttttgggttttttggtaggttttttgtttatagtatttttttaattttgtaaggagggtgggtgcggggagtttcggatatgaaacgagataatttatgtttagttagtggtataggagtgtttgatgttttttggtaattgttattatgattatttttttagagtaatagttttttaaaaagttttgtggtttttgggatagttttttaatttattaaaattttggtatattgtatttattttgtggatgatgaaaattgaggttttggaagattaagagatttgtgttttttgttttattgggttttttagttaagtgtttttttagaataaagtggttttttttgttgtatttttttttgtattttttttttttttattttaatgagaaatgaagggatagagagaggaaggggaaggaaacgttcgggtttatttttttcggggtgttatcgttaggagtgggttgaattgtggttttttaggggtttttatttatttaaagatatggttaaggtttaggttttggaatttatgattgtgattttatttggaaaacgtttttttttatagatttattaaggatttttaaatgggattatttatttagggtaggttttaagtttaaagataggtatttttgtttaaagataagaaggaaagagggtaggttcggtggtttatttttgtaattttagtattttgggaggttaagtaaggtgggtagattatttgaggttaggagtttaagattagtttggttaatatggcgaaattttgtttttattaaaaatataaaaattaagttaggtgggtggtacgtgattgtaattttagatattcgggaggttgaggtaggagaattatttgaatttaggaggtagaggttgtagtgagttgagattgtaatattgtattttagtttgggtgatagaacgagatttcgttttaaataaaaaaaaaaaaaaaaaaaaaggaagaggagggacgggatagagatatagggaagaaggttttgtgataatggggtagagattagagtatgtgatgtttttataatataattaggaatgttaggcgttattagaaggaggaaggtatggatgaggttggtttttagggttttagaaggaaatagtttttgatttcggatttttggtttttggaattgtgaaaatacgtttgtgttgttttaagttttttcgtttgtgttaattggttataatagttatttaagagattaaggtgtgagggttttaggaattttagtagggtaaggggtcgagggtttatttggtttatagagttatagtttattttttttttaggtttagagaggttgggcgatttgtttagggttatataggtgtttatgaaagagtttgtattaggatttagaatttggcggtttttattttagtttttgtttttttgaatttttttttgttcggggggaggtttggggtggaggtatttgtataggttatttgtttttttatttttttaagggttgaatggggataaggagatttttttttttgggtggggtaaggtagtggatgaggttttacgagtttttggtttaggcgtggtttataggttttgggttagtagaagagattgtttttttatttgtttggagtttcggcgtttgcggcgagtattttcgatggtattttatttggttttttttttaaggatttttttgtcgttgatttggtattcgtggttattgtttattatagtaaatgggattattttttggggaacgggtagacggtattggttatatatgtgcgggaaggtaatttttttttttgggttttcgggaggagttgttttgagtttggggttttttaaaaacgagagttttagtttgatagtattgggtatagatatttgggtttagtgttttttggttttaagaatataattttatggtttaaggttttttaaatttttaatttattttttagtaggaattgggggttttttgggaataatattttagtggatttatttattcggaatttttcgtttattagtcggtttttcgagtttttattaaattttttttgggggtatacgtcgatgtcgttggatagtaggtttgcggtgatttgggataaggagggagagagatgggtttatttttgtggtaagttttatttatttattggtgtttgttatatgatttttatattgtgtgttgttttaggttcgggtttaagggtaggttttggggggttgtgatattaattatttttaatttttgtgttttttggagggaagaggggtagttgtaggtgtatttgttgttttgagcgacgttgtaattttttaggggtttaaggttatcgttttgagtattttttatttttttttttttgtttattatagttttaagaaagtatttagggttatcgagatttttttttttgaaattttttttaaaaaattttcgttatagtttttagttttagtaggggtttcgtttgtagtaattttttagttttttgttagtagttcgatatgggtacgtgtaatagaaatattttagtgagcggttgttcgtttgtttaggtatagattatagttcgtgtgtagttttcggtagatatatttattttgtgtggattgtttttttttgtatatgttgggaaggtttttgatatttggttttaggacggagtaggttataggttttatttatatttatcgaggtagatgtggtgtcgtagtttaggtatttcggttttattttgaaaggtattttatgtggttttgatgtgttgttttgttaggaggaagagtttagggttgtttttttgtttggatgtttttttttattttatagtaggggttttagacggtggcggagaagaaggtggtagagattattttttttgaaatttttttttttttttttttttttgagatggagtttcgttttgttatttaggttggagtgtagtggtttaatttcggtttattgaagttttcgtttttcgggtttaagagatttttttgttttagttttttaagtagttgggattataggcgttcgttattatgttcgattaatatttttgtatttttagtagagatggggttttattatgttggttttaaatttttgattttaagtgatttgttcgtttcggttttttaaagtgttgggattataggcgtgagttattatatttggtttagttttttttttatttaataaaaattaggtagggcgaggtgaggtggtttatgtttgtaattttagtattttgggaggttgaggtaggaggattttttgagtttaagggttagagattagtttgggtaatatggtaaaatttcgtttttattaaaaatataaaaattagttagatatggtggtgtgcgtttgtaattttagttattcggggattgagtttgggaggtggaggttgtagtgagttatgattgtgttattatattgtaattttggtaattgagttagatttttttttaaaaaaaaaaagggggggtataaaataaggtgggttatgtcgtacggtttttgttcggttttattttttggaagagagatttattatttgtttggtttaggttttttttaaaattttttttagagattttgttggagaattggtatttttataaagttgtttttgagatatgggggagttggagaggttattttagggacggtttttagtagttatttgggttagggattattaggttagttattcgttggggagagtgattagcggttcggtttttttgatagtgtgatttttttagacggggtggtttttgttaggtttgtagcgtttttaggttgtatagaagggttggggtaagtagagatggaattttattcgttgtttgaagtggatttttttttttagggtgagtgtgttcgttttggcgatgatagggacgatgttgattattttgtttaggcgttttataaattcgatgtttaggggtttgaggttgaagtagagggatgtgcgtgaggtttatttgggggagcggggtagtgggggggtatttatttttaagtaggtgtcgatatttttaggtgttggttcggggtttacgggggtttttgttggtaaggatagggtttcgggtcgagtcggttacgttgtgagtgtggggtagaggaaggatacgggtgtgttttagatataggtgatattattgtataggttaggcgggttagggttagttttaagtattttcgtttatgagttttggggttttaattatatttttatatgtttatatagaagggttgtcgttggtttagtagtcgttttgttgtggggttttggttgggaggggagaggtaagagaaatagaagttagtattagtgtgcggtgtttttgtattaggcgggttgtttttttgtattaggcgggttgttttttttgtttgtttggttttagtgagtttggggtttgatgtggggaaagttgtgggtggtaggggttggtagggttttggaattggggtattattttttttagttttggagtcgagttttttttatagtgagaataaatcggttatatatatggttggggagaagttcgtttcgggtagaagtttaagtagagatggttaaggttcgtttttgttttatgggattggacgttttgggcgggattaggtaatatgtttagttggagttttagttaaagggttagtgttggggagtggtagaagtgttatagatcgttcgttcgttttcggtttgtttagttggtattaggagaggtttttgttttttgttattagttttagttgaggtaaagtttggagtagttggaatagttgttataggatcgtaggtgagtcgttttgtttgggagggtagatgtttagtttaggagaggtttatggatagcgggttggttttttgtttttgatttttgttggtttatagaggatgatgttagagggtgggttcgaaaatttcggtttgggtttttttatagattttgggtgaggttcgttgtttattagttaggtttttttttgtatttggtgtttatagagtatggtttttttaaatttttgggtttttttcgtttagggaagtatatttgggatagtaggtgcgaaggattttttttatttatttatgtagataagttatttacggttgtttttattagttatttttgttggtttttggtttttttttttttagttttggtttagggtgagttataggtgtttggtagggggtgtatagggagttgaggatagagggttcgtgaggttatgaagagtttatttgttagggtatatgtagtttttcgtttttgttgatttttaggggcgacgttaggtgcggatagagtcggcgggaggaaagggtttttattaatattaatagtagtttcgtttagttttggaaggggttagtattgatttttgtgtttttcgtttaagaacgtattaaattttttaaggggttttatgaggtagggttcggatgagaaggttagttatcgttacgggtgtttggttgggggtttttattttatttgttagagtttggtttgagaaggtaggatatagattattaggttttagaatagtttagggtttgtttgatttttagttttttaagacgtagttgaaggatgggggttgggtaggatatttgtataggggttagtgtgaggttttggaggtgtagatatggtatatttttaattttatagttggcggttatggtttttgatttagtttttttgtatttagtagtagggtagatagtatcgttttgtagttttaggggatagagggaatttagggtattcggtatgaggacgtcgatattgtagggacgtacgagtggtcggtggcggggatgaagtagaggtagtagtggacgcgggtgttcgggatgcgttttttgcggttgatgttgatttttttttgtaggtatttttcgtattggttattgatgaattttatgatgggttgttagttgcgtgggggatggggacgagttagtaggtatatgagatgttttttttaagtaggtcgtgtatttttaggatttagagtttaatattttattttttaatgaaatgtatgttttgggaggtttggtttgttgagcggagatgttatagttttattttcggttttttaaattagttttttcgggttggttttaggtgatgagttggggatagtaagattttttaggtaattttgttttggtttagaatttttaggtttttgagacgtgcggttttggtagtatgttaggttttaggaggtgggttttgtattttcgcgggtcgggaaatttttagggttgattttgggtggggtttagggagttttgaagttttcgttagtgtttttttttttggaggggttttattagttttcgttgttgatgtggttttcgaattttggtgtgttaattattgttagttttattcggacgtttttttttttaatatttgtatagagttacggacgtagagttagaggggagacggaagatttttatagatattttatatttgattgatttcggggtaattttaggtaggtagcgatgataattaaggagatatcgggaaattaatggttttttttagttaatttcggtataggtcggtgacggtttttttgggagttttttgtttgttagatttttggtggaaaatttagttgtttgtggggagtttagtgtgacggggtttataggggttcgggatattgatttattatagttagagttttaatatgtttaatatgttggggatggtgggtatagcgagttttcgttttggggatttgggattgtttgattcgggtatttttatatcgtattagtgttttaggaaggtatgggtattttatatttttagtttatttttagttattgatcgtgtgtgatggttttgatttttaatttttgtgttttaggaaggtaggggcgttttgtatttttagtttattttcggttattgattgtgtgtgatggttttgattttttattttgtgttttaggaaggtagaggagttttgtatttttagttcgtttttggttattgattgtgtgtgatggttttgatttttaatttttgtgttttaggaaggtaggggcgttttgtatttttagtttattttcggttattgatcgtgcgtgatggatttgatttcgatggttttggggatgcgtttttttgaggtgggttgtatcgattttcggttgattttggatttgaagagggtgttgattaaggtggatttatttaagtcgttttgttttggggagaggatgggaggtcggttaggggttttttcggagagattagtagggtttgtatatggggttttttttatttaggtacgaggttttttagtttgagatttagtagtgtttgggttatttttcggtaatatttttgttaagtagttttcgaggattttattttcgagtcgggtgtttagtgattgtgtaaatttatatagtcgggttttgatgttagtataatttaggttatagtttttttttgagaggtgagtcgggtttgggagagtcggtattttttgtgttttttgtgttttttggataggaggttttttggtggtttagattttggataggatagaggtcgggttggcggaggagtttagggttgtttagggtgtattaggtggtcgggatttttgtagtttattagggtggttgtaattaaagtttaggtgtttaaattgtttttttttgatcggttagggtttgggtaagttatttgattttatcgtgttttagttttttgatttgtaaaatgggataaatagtttttttttcgtggagttggtgtgagtattaggtaggtttacgtatgttttatggggtttgtggggttatgtgttagggggcgttggtttgtagggtggtgttattcgagggatagtgatcgtgtgtgtagatagttagtttataggtgattgagataaacgaggatgaggaagtagtatttatatgtaatataatatatataatttatatatattttatatatatattttataatatatatattttatatgtataatttataatatatatataatttattttaaatatattttttatatatattttatatataatttttataatatatataaataaattatatataatacgcgcgcgcgtgcgcgtatatatatatatatatatatatatatatatatatttttttagattcggagttttattgttttattttgtatagagttgttttgggttacgttagtaatatattaaaaaaaatattttaggttaggtgtggtggtttatgtttgtagttttagtattttgggaggttgaggtaggaggattgtttgagtttaggagtttaagattagtttgggtaatatagagagattttgtttttatattaaaatgtaaatattggttaggtgtagtggcgagtatttatagttttagttacgtaggaggttgaagtaggagaattgtttaagtttaggagtgcgaggttgtagtgagttaggattattgttattttagagtgatagagattttgttttttaaaaaaataaaaatcggttaggcgagatggtttacgtttgtaattttagtattttgggaggttgaggagggtggattatttgaggttaggagttcgagattagtttggttaatatggtgaaattttgtttttattaaaaaatataaaaattagttaggtatggtggtatatgtttgaggtacgagaattatttgaatttaggatgtggaggttgtagtgagttaagattatgttattgtattttagtttgggtaataatgagattttgttttaaaaaaatataatataaaaaatattttaaattatattgatgttttgattttgataatatttttttaggaaaagtgtgggtttttgggaggatagaggttggtgttgggaatttttggtttgaattgtttagtagtttaaggacggatatttttcgtttatttttttttgtttattaggtttgtgttttggttaattttaggttaggagttatgttaatgttttagttacgatattttagatttaggagatgttaattgggatattgtaaggtgtatttttttattattgttatttttattattattattattattattattatttttattattattattatttttattagtattattattataatattattattgttattattattattttattattttcgttattattattattttcgttatttttattattattattattgttattataattattagtattagtattattattaattatattattattattattttattattattattattaatattattattatttttattattattattattattattaatattattatttttattaatattattattatttatattattattataattattattattataattattattattattttttttattattattataattattattattattattattattataattattattatttatattattattattatttttattataattattattattatttatattattattattatttatattattataattattattattatttttttattattattattattattattattataattattattattattttttttattattattataattattattattattttttttattattattataattattattattattttttttattattataattattagtattatttttattattattattataattattattattattattattattattattattattataattataattattataattattattatttatattattattattataattattatcgttattattattataattattattattatttatattattattattataattattattattatttatattattattattataattattattattattattataattattattattatttatattattattattataattattattattatttatattattattattataattattattattatttttattataattattattattatttttattattattattattattattattataattattattattataattattattattataattattattattattattattattattattattattataattattattattattattattataattattattattattattattattattattattattataattattattattattattattattattattattatttatattattattattattttattattgttattattattattattattatttttattatttttatgattattattattattatttttattattattattattattattataattattattatttatattattattattattttattattattattattattattattattatttttattatttttattagtattattattttattattattatcgttattattatttttattatttttattattataattattattattattgttgtaaattttcgaataattataatttgttggggattttgttcggggtttagttcgtttgattttattttatgggatgattttattttatggacgaggaagttaaggtttatagaggaggagtttaggggaagatatataagttttatttcgttgagttaggataaagttgggatttttttcggggtttgtggatttttaaataggtgtttttttattttgtttgtatttttgtaggtgggtatagttgttatgggagggaggagggaggagagtagagttgttttacgttttgttttttattcggtatttttgggagggagtgattttgtggggaattaggattattgttttttttagggttgaaagggcgaagaggtttagataggtgaagtggttttttgcgtattatttttagagggtaaggttgttatagtggtagttacggaaggcgagggttgttgggttgtttttttttttttttggggttaaagtttcggaagaaggtttgtgttatggttgggacgtagaggtttttaggttttttttattttgtttttggttagggagtagggtagttttttcgtagtttatagagatgagttttagtttggttattgtttttgggttttttttttttttttttttttagttattttttcgggaggtagttttgaatttttagggtataagtacgttttttataataggtagaatagggtgggggtcgtaggaggggattttatattttcgtttttttttgaagtaggttgttagtttttaggtagttgtgagtatagtagggttatgagtagtcgggttttatgaggttataggaagtagagaggatattaagattttaggggagttagggtttagattagtgtagaagaggaaagaaaggtgtcgggttggtaggtgtgggtttgcgtttatagagttgggtaggaaggacgtgtacggttggtaaaggttagagaaataggttcggtttgagaggtgtttagatattttgtagaaatttcgtaagtttatttttgtttagggtgtgatttggcgggggtatttttttagatttttttttggatttcgtggagtgggtagaatatagttttgggagttaaaacggtggttgcggttttttgttttgtgagttaaggaattttggtagttttttttgagtttcgtttttgtttggaaaacgggacgttttttttatagggtttttgtgaggtttgaatgggatttggggggttttggaaataataggcggtttattgtagattttagtttggtttttttattttgtttaggtcgtgttgatcgacgatttttcgtggtgatttttagtttttcggggttattagggggtgtggaagttacgaggttttaattttagggtagagttgaagttgagttgttgggaagtttttggtcggggtgcggtggggtgcggtggggagtttggagggttaggttggagtaatagtgaggggatagttgttatagaattttttgtataagttgacgttattgtttagaggtagcgattatttattaggatttgttttaggtcggtttgggttttttaaagttattttaggggttttggatgtgtaggataggtttttttgaggagtcgttggaggttgtgggttttttttaggcgtatgtatgtatacgtaatgttattggtaattcgtttttgaggttagggttgttgttttattttatagaagggaagattaagtttaaaggtttgtgggtcgttttgggggttgaggttggttttcggtattggttgagtggtatgtaaggtgaggatttatcgattattatgatgttgaattcgaagttttgttttatggtttttcggcgtatttgttttaggatggagttaatttttacgtagtcgaagtttatcggggttttttcgtttcgtgatgtaggcgtttgtttgagttcggtatttttgggggtgtcggttatgtcgttaacgtagttgggagtcgttttagtggttggggaaggaatagtagaggagttagagcggaataggggtttatatataggcgtttgttaggtggttgttatatttatttttggatggggaaattgaggtattgaggtttagaaaggttaagcgatttgtttaggcgatttttgagaattttttcgggtggatgtttttggtcgtggtgttttttaaaaagttgttattttgtagttacgttgtttttttagtaaagttttatttttagatttttaaggttaggtttttttatttttttttttaggagttgtgttaagttgggggttttttgcgttttaaggtagggttgattttgaatttttgttttcgtattttggagggttgtttagataagggtggagggtgttttttttttttggttttttatattgtttcgggttatttaggtggatttggtttttttttttatttttatttagataagttgtatcgtttgttgttatttaaaggttttagaagtcgatttacgagttaagatataggagggatggttttgtaagaaacggggatagaattagcgtgtgttttcgttttttatatttttatggatggttttgtaagaaagggggatagaattagcgtcggtttttatggagttgtgtgtttaattttatagaacgagttagtagttttgggagaaggaaaagtgttgggtgtagggcgggtgtttggatgtagagttgtttttgggtttatggaggaggggggtttttgtattatatttgtttttttttggattgatttaggcggtcgttttgtgtgtttggttagcgtttacgggttgtatatttataggttaagattaagttttatttttgggtatgtggggtacgtggagttgaatttttcgaaattattaaagttttttttgtttgtaggttttttcgatggttttgtttttggttgttgttaagatattatatacgggttagaggtttggggttgggggcggacgttcggaagacgtttgttgaggatttaggtgtttttatatagtggggttttaggggtatttaggatggggttggtttttattagggttggttggtatacgggttaggttttagtatattttagattcgttatatttattggtgtatgcgtatgtaggtgtagataattcgttggttatagaggtggtgtttttgttagtttttataggttggagttgtttttggtggtttttagtttttacgtaggttgggcggttgttgttttgtgttttcgtttttgtttgggtttatttaggttttgttttgtttgcggggagatttttgttttattttgttttttagggaggatttggttttaggtattttgcgttaagatagggattatacggtacgtttttaggtagggtttttttcgttagtttttcgggaggggagtggtttttttttgggatcggtgggtatttagtaggggtagttataggggagtggagtcggcgtgggagttagggttatagtacgggaggttgtagggggtttatttttcgtgataggtaagtgagtagtttttttagataggaggtagttttttcggtttacgtttattttttattttgtttagaaggtgggaggtaggtttttaggttaggaggggtagtgggagattttagtttaattgtttttttatttgcggggtaagaatcgaatttaggaaatgtttattgagttttttggttgtagtttgtatttttagtcgatttaagttatttttttcggtttattttattggagcggttagagggtgtcggagggaggttttttaggtttgaggtattagaggtgagagaggaaaagattttggaagttagaaattgggggttggtttatttttataggtattttttcgtttttttagtttttatagggtataggaatttttattttatggaattgggggaataaaggaataatataattttttgttgggaaatgttaagggggggtttatatatttttattgttgagagtaatatttataggcggatttggaggttagggtttttttttttgtgtttttacgtggtttttatttaggttacgtagtttggaagtttttagggttttgtttttgtttttgttttttttttagaaatatttttttttgggtttttaggatttttaaataaataaagatatagttttgtatttggttatggattatgtggttttggggtcgttttttgaagttagatatggggttttgttttgcggggtagtagtttagtttttatttacgtgatcgaaaatcgtttttatttgtttgtgggtttgagagttattttgtttgggattgggattagtttttattcgtttttatttttttttagtattttttaattttttttagtaggatttggggggaggcgttgttttttgaatttttttttttcgtttttaacgtttttggagtttagagcgagggaggggtcggtttagttgtagttgggtttttttataggtattagtatttattgtagaaatttaaattaaattaaatattttgtttattaggggtttcgtttgagaaataataatataacgtagtcgagttttatttttgttattgacgtagggtagtggtttgttttttgtataggtgagagttatttttgtaatttttttttcgagaggcggttttgtaggtttcggttggttcgtaggtaggtacgtacgtagagagtaatgtaagagttcgtttcgtttttttatttggttaggtgagttttggggtttgtttttaggatttttaagtgggaaaagtagagatttttatatttagagatatttttattttggttttaggatattatggtgtttagatagttggaaataatggtaaagattatttattttattgtttgtgattacgatatcgttcgaggtttgcgttgtttagcgtggtagttattggttacgtgatttttttttttaattgttataacgtttgttacggttattattttgaagtgtgtagtttagtggtgttaagtatattcgtattgttgtgtaataaatttttagaatttttttattttgtaaaataaattgtttttattaaataattttttagttttattttttaagtttttggtaatttttattttgttgtttttttgaatttgattattttacggatttggtataagtggaattttataggattgtttttttgtgattaaattattttatttagcgtaatattcgaaaggtttatttttgttgttgtaggtattttaattttttttttacggttgagttaaattttttgtatgttttattttttttttttttttttttagatagagttttgtttttgttgtttaggttggagtgtaatggcgcgatttcggtttatcgaaatttttgtttttttaggtttaagtaatttttttgttttagttttttaagtagttgggattataggtattcgttattatgttcggttaattttgttttagtagagacggggtttttttatgttggttaggttggttttgaatttgtgattttagatgatttattcgtttcggttttttaaagtgttgagattataggcgtgagttattacgttcggtttgtttcgtttttgatttttttatttatttgatcgcgggtattcgggttgtttttattcgttggttattgtgaatagagtcgttatgaatgtgggtgtataaatatttttagttttttaagatgttgtgtatttttttgaatttatatttagaagtggaattatgggatgttacggtggttttagttttcgttttttgaggaattgttatagtgtgtttataagtgatttttgagtatttgatattgagttagtttaattgaggaacggaatttttatttttatttaaatttaaatagttatattttataaatggtaattatattggatggtatagaattttagtttaatttattttttattaatggggaaattgaggtttatagagtgatttttttttttgaaatgttattgtaagtggttaggttagtataagatttttattgaatttggtaattttgaaattttatatttttgtttgtatgatatgcggttaatatttgtgattttttttaaagatcgtgggttttagtaagacggtagttgtttcgttgagatttttatcgtatttttaggtttcgttttgttacgaatacggttgtgtaaggatttgtttgggtttttgttttttattttttcgggtatttagattaattattagtagtatttacgtcgatttttagaaaggttttgatttggatagtaattgatacgttattttatagttaaagtaaaatgtagagtttttttttcggtttcgtagttgggagttagaggttttaggttttggtttttggtttaaagtgattttttgtaagtttttttagtttggtaaataggttatgtattttttgattttttttttagtttttgttttgcgagtttttgggtgttcgaggttgtggtttatttagtgatatttttagtttttagtgtagttcgtgagtagtataatatattcggttttagaaataattaatatattcgttaatagatgcgtggagaaatttaacgtgttgagttaatatagcggattattttttagttataaaaaggtacgagcgtgcgttaatatagatgaattttgaaaatattttaattgtaagaaattaagtataaaaagttatattttttagggttttagttatatgtttagaataagtatatttgtagggataaagcgtagattggtgatttttaggggttgggggagggggagtgattgtgtatcgaggatggcgtttttttttggggtgaggaaaacgttttggaattagaggtgatgtttatagaaggttgtgaaaaaatgttatttaattgtgttttttgaatcggcggatggtgtaatatggaaattatatttttatgaggacgggagaggaagggaaagaagggaaggagggagggggaaggaaatagggaaggaaggaaaaaagggaggggaggagggagggacggaagaagggaaagaaggtagttatttttagtggagttggattgaagagtttaatgggtgtagtaaattattatggtatttgtatttttatgtaataaatttgtacgttttgtatatgtattttagaatgtaaagtaaaataaaataaagagtttagtgttttttataagtgtttaggagttagttttatagtttagaggatagttgaggtttagaggttaatatttaggtttgaggtttttaagttggtgtcgttagattatgttttagataaatttttttatttttttgtagtaagggtgtttttagggtggtagttaggcggaggtgttaggtggcgggagattttgatagtttttttgtaggtttttattttgaatttaggttttatgttagggtttttttgttatttattggcgttggtggtagtaggttatcggtttcgtgatggggattgtttttaaatttgtttattttggggattagttttttttttttcgtaggcgtttattgggttattttttttttagagttgtaggtgggtttaaggtagggatgaaagggttgtaatttacgtagttttgagttagtattttttgggaatatttgtatttagtgataaatttttattttaattttaggatttgtcgaggatgagggaattagattgttgtttgtggttgggacgggggttgtaggatatttggttgggaggtagtgtttagagaggaggtagttattggatatgatatattttaggggtatttatatttattatagttttagggttgattttggtttatttggtttggtgtcgagagagggtttgatatagtaggtttgtaaagtttgatttggaaattaagatttaggggtcgtttttttttgtttatttttttttgtgtgttatgttgtttggtttacgttttagaaatgtttatataagttttattagttttgttggttaaatgtagagatggtgtcgttggggtaagggattttgagttatcgtttaatgttatttttagttttaggggagtgatagtcgggtttgtattttaggataaagtgtttagggttaagttaatgttatttttttgttttttttaaatttaatttatatttggtttttagagtacggatcgaaatggttatatttttatatattttgtttgttattgttaatggtggttaagtagaatgtaaggttattttttttttgtttacggaggtttgtgaagttattgattaggttacggtaggggagtcggtggtatttattatattttgttagttttttaggttcgtgtttaggagaaagttgtcggtatttatagttggtgtttttgtttcggcgaagatttttttgtttttatttatttcggtttagcgtgggtttagtagtttttttattttgtttcgtaataatgtatattggagtagtttttagttgttttttttttgtaggtttttttgaatttagattttggggttagtatttttgcggtagttttacggttatttgtaggtttttttagaaatttgagtttatgggggtattttaggttttataaattaatagatgttttttgttttttataaaggggttttttaaagttgagtgagtttttgatgtaggtaatgttaggaggatagtgttcggttagggttgtttttttttttttttttatttttttgggtgtttgtaaagttttttagatttttgttgaattttggggaagttttgtttcgtaattagggtttgtttttttcgtttttatatagagtttgttttttgcgtttagatagtttttttacgatggtaattgaataatgatgtgtgcggtttttttttattataatttttttatatagggtttgtgaagttagatattttatttattacgtttattttagttcggttttttttagagtagcgtagggtttacggtaagtttcggtaaaaagtttggtgaatgaatgaataaatgaagaaataaagtttattatagtagtcgaggtttattgggggttttttgtgttaggcgttattttaatttttttttttagagagtgggttttattaatgttggttaggttggttttaaatttttggttttaagcgatttttttattttggttttttaaagtgttgggattatagatataagttattgtatcgagttttaggtgttattttaaacgttgtttaggagttattataattgatggattattatataattttataaggtagttattgttattgttttattttatagataaggaaatcgagatcgagagggtttttgttaattatgagggtcgtaaagcgagtaagcggtagagttaggatttgaagttaggtaggtgagttttaggttgttgattttttttttaggttaggttttcgggaattatggaaaggttggagaagtatggggtttttgtagttaggatttagaaggtgtagttgcggtgtaggtagtttagtattgaggttttggtttttagttttttttttagttgtttttttttagggagttggaggtagagttttgaattgttaggagaagattttattcgttagttagggaaagttgttagggttttttttagggtttagagttattttaggtttattaaagtatattagtattttagtttttataattttttttgtaagaaagatgatggtattagttattgggtcgggttgggggttttagattttaggggtttttttaggtttgtttatggtttttttaggatatagatgtttatttgagaaattttagtgtattaggggttttatagttaaaataaagaggtagagttgttttggggtttttgttaaagtttttaggtagatttatttagtagatattaaaatgtttattttttatttgaaaattttatttttaggaggtcgttttaggttgggttgataaaatttatagagattttaatgatgattttttattttaggtatgagtgagtgggtggagggagaagttattgttaattattaatagtttaggaaatgtaggtaaaggaaagagaatggtaaggcgatagggttggaaattagatatacgtgtagaggtgagtagattttagagaaagaattgttttggaataagatggtaaagaaattatagataataatggtagacgatgattttggggttttagtggattaggattataatattgatttatttgataagtatttattgagtgtttattttatagtaataaaaagatgatattataggtttgagagtagttagaatgaaaatagtggtggtatatgggaatttgaagtttatttatttaaatgtttattagtcgagattttcggatagatttgaagtagtttttaatatgtaaggaatttataatttgatatagtagtataggatatgtgtgtgttataaatttttggtgaaaagtaaagattttttttagaaaagtatatattgaagatagatagatagatatatacgtattttgaacggtttattaaagaatttttaggttcgtggattttagttaaaaaaataatttggtattttgggaggtcgaggcgggaggatcgtttgagtttaggagtttaagattagtttgggtaacgtagcgagattttatttttataaaatgaaataaaataaaatgagaattaaaaaaaataaataaatttggtgtgatgagaatttatagaatttaatagggttattttagtattatttgtagtattttttaaatttttgattatatatataaagttttgggttttatagttagagaagagggagagtaggttaaaaataattatttaaggtggaagatgagtttgagaaataaagaggtaagaggagaagattgaggttagttgttttttatttttgagtttcggtaggaggaagtttttaagtgagaataagttgttgtttgcggagtggattttagagcgggtggatagagacgataaggaatgttatttttggggggttttgaaaataggatatttttttattttaattttgttttttattgtattgtgtttttattgatttatttaagttattataaatattttataaatgttattggggattttttgtttttttttaaagatggaaatattgaatataaatgattaaattgtgtaaatgtgtgtgggtgggggattaaggattgaatttttaaaatgtatatagtttatttaatttgttaattaattttaaattaaattatattttatattttgtatgggataggaagcgtttttttaaagtttggttaggatttgggatgtcggaaatttgagattttgttttttttttttgagatattttgaaattttgtttagaaatcgagtataatggttttggttttttagagaaagatacggatttgtaaaggtaaagagttgtattttttttcgagttggagtttttttcggtttttattatggggtttaaataaaattgtagttttatagtttttttgttggtgtttttttttttttggtgattaataaggtggaagagttaataagaattttgtgtgtttttttgtaggatttggaagggataggtggtgtgagtttgtttttatttagtttttttttttatttatttaggggtcgaggcgttttcgaggtagggggcgggggtttttatttttattgtcggttaaggtttttttagtttttttttcgttaaatttttttaagtaaattttttttttattgtggaggaaggaattttaagtagttttgtttttttgttagtacggttttaattggttttagtcggtaaagttaaatttggataaggtttaagggttttttatattattcgtcgttttttggaagaggtttttttttgtttttttatttgtaatttattatttttttagtttgagtttttttatttaggtttcgcggtttattgagatattaattttgggttagagtaagttttgatttgtaaattattattatttattttttaaagagttatttttagaatttaggttgtagggagggtaggttaaggatgaattttttgatttttggtgcggtgtgtggtggggggggttattttatattttgttttttgttgtttttttgttttgttttaggttttgaagtggatttattgtagagggagggttagggaatggttttgatgttttttttattttaaggaattttttagtaggagcggtttttattttaaagtaattttaagatttagttcgtgttagttttttagttatgtttatagtggtttgttaattagagatttttttagtttttggtaaatttgtaaatttataaagagaaagaaaagttttttcgtgggtgggtggatattggttatttgttataggttggaatttttttttattagggatgttttttaagtaggggttggggagggtagggtttagagtttttttttttttagttttttttgttattagtagatttgttagtagatatatagtagagtttagtagtgaggtaataataggggttgtgggggttggggtttcgttttttttaatttatgaaattatttgaaataataaaatttagataagggtttttggggtgtaatagggtggttttttgttaggtgttgggtagaaaaaaagtttttttttaatttttttttgttgtgtagattagttcgggttttggggatgttgtagaggttgttttatgtttaggttttttagagatagtagggggttggaggtacggtttgtttgggggtaggggataggtagggaggggtatatttttgggttatgagtaggagtttgattaaatgatttttttaggagggagaaagatatcgtatataattgtttgattatagttagaggggttggaaaggtgggggaaaggggtgaaggggttaattgttttaggtgtttttaatttatgtagtatttatttggattgataagagttgagagattggaattgtttttttttttcgtttttaggttttgttttaggagtttttttgtttaggagtttgggagttgaggaggtttggaagtagtgggtttatagtgttatcgttttgggaatttatagtgttttggatgtggttttttcggttttagttttgtaggtagtttatttggattgtatttattttttagaagagttgtttagaattttgtatgttcgaaagaaagattaattaaagaagtgaggaagttaaagagaggtttatgaaagtttatgacgtattttttaagtgtatattttagtaattttaaatgttttttgaagtaaggatggggatggatggttggataaatggatgggtgtatgggtgtgtgaatgggtgagtgggtgggtggatggatggatagatggatgaatggatgggtaggtggatgaataggtaggtgaatggatgggttggcggatgaatgagtaaatggatgaatgattggatggatgggtggatgagtagataggtggatgagtgaattggtggatgagtggatagatggatgagtggatgagtagatgagtgaatgggtggatgagtggatgggtgggtgagtggatgagtagataagtggatgggtggatgagtggatgggtagatggatgggtgagtggatgcgtggatgagtggatggacggatgagtggatggatggataagtggatgggtagatgagtggatggatagatgagaggatgggtagatggatgggtgagtggatgggtgggtgagtagatgggtggataagtggatggatagatgagtggatgggtggatgagtggatggatatatgggtggatagatgggtgagtggacggatgatgagtggatgggtggatgagtggatggttgagtggatggataaatgggtgaatgagtggatgggtagatgagtggatggatagatgagtgaatgagtggatgggtggatgagtggatggatagatgggtgaatgagtggatgggtggatgagtgaatgagtgaatgagtggataggtggatgagtggatgggtggatgagtgtatagatagatgggtggatgggtggatgagtggatgggtgggtgagtggatgggtaggtggatgagtggatggatagatgggtaaatgagtggatgggtggatgagtgaatgattgtagataggtggatgagtggatgggtgaatgagtggatagatgggttgataggtggatgagtggatgggtggatgggtgggtgcgtggatgggtgagtgagtggatgggtgggtgggtggtaagatgggtggataggtatatggagtttatttaaggagttttagaaatatatatatatttttttattttagattttttttaggaaaaagtagtgtgtatggatcgttatttggttatattttgagatagttatttttattttttttggaatatcgtttggggggatgtagtatagggtatttaagtaatttttgagtttagggtagagatattaggaagtagtaggtaggtcgtgatttcgtaggtttgttttatggtttttgttgtttgtattatggtatgaagtttagatgtatttttggatttggggttttgattagatggagttattaattttttgaagaatgaaatatataggggttatttttgttttttagttgtagggaatgacgattatttagttttttttttttttaaattttttttaggtttttgtgtatggttttgttgattttttttttgtttttggttatttttttagtttttgtcgttttttttttcgtttttatttacggagttagttttggtgttttgagagtttttttttttagttgattttatttagtttttgagtatttaatgttaataatgttattttttttgtttagatttatatttgagtgttagtttgatttatagacgtgtttttgggtttcgttgtgttaggttttttgttgggttttgggtatttgtagttattgttattgttaagttttaatatttgaaggtattttgaatttaatgatcgtgttttaggttgaattttggagtttttattttatttgttttttattttattttttatttaagtgaatagtttttttagttaatagttattgtagttagatttttaggggtcgggtttgggttttttatttttattatttcgaatttatttatttattttaaatttttattaatgttaatttaatatattttatagttattattattagttgtttttgttcgaattttttttttttaaagtattagggggcgtgtgtaaaatttattaatttgatgatttttttttatgaagtcgtgattggtttttattgtatttgggatatattagatttttgtggttttagaattttgtttattatcgacgtgttgtgtgattttgagtaagtaatttaattattttgtgttttaatgtttttatatgtgaaatgggataataatatttgttttataagaatgttggggattaaatgagatatttatttatgaagtatatagtgttgtgtttggttagtaaatgtttgaagtttttgttaataaaatatacgtttttaatttattttttagtttttatttacgtatagtttttttggttgttttttagtttttttaataaggttatttatagaggttttttttgtcgggattattttttttttatgttgtttttagaatttttatttgttttttcgggatagtttatttatattgggttttttagtttttgttttgttttgttttgttttgttttttttgagatggagttttattttgtcgtttaggttggagtgtagtggtattatttgggtttattgtaagttttgtttttcgggtttacgttatttttttgttttagttttttgagtagttgggattataggcgttcgttattacgttcggttaattttttatatttttagtagaaacggggttttatcgtgttagttaggatggtttcgattttttgatttcgtaattcgttcgtttttgttttttaaagtgttgagattataggtttgagatattacgtttagtttaggttttttagtttttatatacgtggtttttcgattgttgtttggggtttgtcgtatttattatttataaaattttatacgttcgaagtatttagtaagacgttgtgaatgagtgaatgaataaatgaatgaatggttagtttgttgttttttcgttcggtttttcgttttttttagattagtatgggggtagttacggttttcgtttatttcggtaatatcgttttttttgtgtcggtcgcgttggttagagtttttttttacggcgttttcgcggtttcggtgtgtggtcgtttgtgaatgagatttatgattttcggtttttattatttttttggagttataaagtattaaggcggaaggatggatgggttttttgggatagtcggggtgggaggtcggtttaggaaattttttttaggaaatggttagtgtgggatgaggcgttcggtgggaggggagtggagtggggatttggggtttggttgttttgtagttagggattttaatttttattttttttttcgtttattttttaattttagtgttgggtttagggtttttggggttttttttaggaatatagaagatatagtaaggattagggatataggataggtagagtttatgggtaggaggtttttagttagtatatttgagtttatgtttggttttaattagatattgagattttggttaggttattttttacgttgaggtaggggggttttttagaggttattggtttttaagtatcgcgtggaagatatgttacggagagttagtattttttgagatattagtagaaggttagacgtttcgcggtttaaggatgatttggttttagcgtttatttatttgtcgttttgtatgaaaagtttgacgtgatatggtcggttttagcggaagagtgattcgggaatcggtagagcggatttagtaattggtaaattggatttagtaattgagatattgttaggggtttggtagaagttttttaatgtattagatttagttttgatttttatagagtttagtcgagtattaaaaggtgtagaggtcgagttgagtattaggggaatattgattttagggttgatcggtgttgtgcgtgtattttatagtttatagacggtttatatttattcgatcgtatttgatttttttttgcgaggttttttttagatttttcgttttttaaagttattagttgtgttttttgaaattagagtaaagtaataaaattgtagtaatagcgtgtttttatgaacgttgtgatgttagttggttaaatgagggagtttttagggttttttatattgtttcgattttgtgtgttttttggttttggtttattttttatattttttgttttttttttttttttttttttcgaggatttagggtttggggttgatttattgtgggattttaacggtgattttttggaagaaatgttcgttttttttttttatttagtagtgatttttggttcgtttacgtttacgtagttaatataggtagtagtcggaatttggaagtttttggggtgggagtttgtttttttttaggtttttttagttcgaatttcgggaaggagttatatttatatggtaattttttttaaggttgggagggggaaggggtttggttcgggtttgattatttttttgaggttgcgtttattgggttttttaagttagttgggtttttcggttgtatttttgagggatggtaatagattatagtgtaaattgtttatcggttggttgggtagtgggtgtttagatgcgggttagggttttcgttttataggttgtgtggtggtttaaagtgggtatttttatgggtatatatttgtgttatagtttattcgtgtgtgtgtgtgtgtgtgtgtgtgtgtgtgtgtgtgtgtgtgtgtgtgtgtgatagtttagaaatatggtaatttatagtttttttaagacgttggttttgggagatttgtttatttgggggttttagtatttttagttttttttaggaaggttttgttttttttggtttgaagttggttttagggaagaatttttttagaaaaataaaagttattttttttagttttagtttagtttttttttaggggtgagttatattaaatttattttttttttttttttttatttttttttttacgttgtaattagttgtaagtggtttatttatttaggtttgttagtttattatagaaaagatattcgaattttgtattttttttttttgatttgttttgggttttaataggtaaaggaaattggaagttagtagttaggatttagttgtaggttttcggggttattttgcgtttttattttagttttatttatttttgcgttgatttaatgtttatttattttagtttatggagcgaggtttggatttaagataaaataaagggggttttggttttttggggtttatagtgttcggtgtcggcgagataattttagagtatagtatagagaaatggttgcgatacggattcgtagtatttggttggttaagtatagtaatgtatttttattaggtttgggttttttagtagatatatggtttaaaggttggttggttaaattatatgattttgtaattatttaagagaaatgaaaatatgtttatataaaaatttgtagattagtatttattgtagaattttttataatagaattatgttaaaaagtagaaataatttaaatgtttattagtagatgaagagatatatagtgtggtttatttacgatggaatattattcggttatgaaaaagaatgaagtattagtatttgttataatgtggatgagttttgaaaatattttattaagtgaaaggagttagatattaaggttatatattgtacgattttatttatataaattatttagaataggtgaatttatagagacgaaggtagatgagcggtggttaggggttgagagttcggagttgggaatggggattggttaatgggggtagggttttttttggggatgatgaaatgtgttgggattaatggcgatggttgtgtaattgtgatggttaattttttgtgttagtcgggcgtagtggtttatgtttgtaattttagtattttgggaggttgaggcgggtggattacgaggttaggagattgagattacggtgaaattttatttttattaaaaatataaaaaaaaaaattagtcgggtgtggtggtgggtatttgtagttttagttattcgggaggttgaggtaggagaatggcgtgaatttgggaggcgaagtttgtagtgagttaagatcgcgttattgtattttagtttgggcgatagagcgagatttcgttttaaaaaaaaaaaaaaaaatttttgtgttaattggattgggttatggggtatttaggtaatcggttaaatattattttgagtgtgtttgtgaaggtgtttttggatgagtttaatatttaatttttttattttttagaaagtttagtttattgttagtatttatttaattttatataaatacgttttttgaggttgaagtaaatttgattggatgttttgtgtgaaaattaaatataaaaattggttaggcgtggtggtttacgtttgtaattttagcgttttgggaagtcgatatgggttaattatttgaggttaggggttcgagattagtttggttaatttggtgaaatatcgtttttattaaaaatataaaaaattagttacgtgtggtggtaggtattttgtaattttagttaaatttaggaggttaagattggagaattatttgaatttaggaggtagaggttgtagtaagtcgagatcgtgttattgtattttagtttgggtaatagagagagttcgttttaaaaaataaaaaaattaaaaagaaaaaaaattttttaaattgtttttgtagttatttttaagtaaaataatagagttatttgagtcgtttattttggaaaaattagatttattaaatgaatttttagttaataattgattaagaataatgttaatattatttgtaggaatgttgtgttttttaggatttgatatttttagcgatcgagaattattatttttttttaaattttatttatttatttattttttgagatggaattttgttttgtcgtttaggttggaatgtaatggcgcgatttcggtttattgtaatttttgtttttcgggtttaagtaatttttcggtttcggttttttaagtagttgggattataggtgtttattattacgtttggttaatttttgtatttttagtagagatgggattttattatgttggttaggttggtttttaatttttggttttaggtgattagtttgttttagtttttttaagtgttaggattataggtatgagttattatatttagttgagaattattatttttttttaaaggaaatattattattaaaaatggaatgttataaatagaatgatgttttttgtttttaaagtcgatatattagagtgatgtgaaaataataataaaagtaagatatttttcggtaaatttattttggggtgaacgttgtagttataagtattgttggtgagtattttcggggtaaataggaaaagggtgtaattaggagtttgggtaaagtagattgtgtgttttgatgggggtgggttttattcgattagttgaaggtaatagggtttggaacgtatattttaagatatagtgttttggtatagtaaatatttttagttgaaggaatttaagaaatggtaggtttaagaagaatttattgatttgttttttttttgaagtagattataagttttttacgtaagaggtgttttttttatatttagcggaaaggaatagttttatttttagagatagaggatttgagaggggttttagtatataggttttgtcgagatttttacgggtttattgtttagtttattttttgttgttttgttatagttttttacgattttttattttttattaaatttagtataaaaacgtttaggtttaggttaggtatagtagtttatatttataattttagtattttggaaggttaaggtggttagattatttgaggttaggagttgaagaatagtttggttaatatggtaaaattttatttttattaaaaatataaaaattagtcgggtgtggtggtatacgtttgtagtcgtagttatttgggaggttgaggtatgagaatggtttgaatttaggagatagaggttgtagtgagtagagattatgttattgtattttagtttgggtaaaagataagtaaaagaaataaataaaaaaattgtttaaaataagtaataaataaatttaaaaaataagtaaaataaataaaaattgtttaggtttaggtcgggtatagtggtttatatttgtaattttagtattttgggaggttaaggtaggaggattgttcgagtttaggagtttgagattagttcgggtaatatagtgggattttgtttttataaaaaataaaaaattagttaggcggggtggtatatgtttgtagttttagttatttgggagtttgagttgggatttaagagtgggtttagagtagttttcggggtcggtagttgggttttagtttgagtttaggaagttaaggttgtagtgagtcgtgatcgggttattgttttttagtttggacgtgcgatagagtgagattttgttttaaaataaaataaaaatcgtttaggttaacggtttttttgggtttttatttttttatgaaggttcggtgttaagtaaaatttatttgaattgttatgtttgttttttgttaatttttgttagtttaatttttagggttttagttaatgaatttaaaatcgatagaaggaaagggtttttttttagattttgttttgattaggtttttgtaattttgtgataaaggtttgaaggtttgaataggaggatataaggtttgagtgagagagaatttttttcgtttaatcgtttttaatttggaatattagattttttttgttttagatttaaattgatatatgcgttttttttgggtttcgggattggaacgacgttattggtttttttgggttttgggtttttaggtggatattagagtcgtaatatgggttttttcgtgtttttagtttgttgatttattttgttaattttggtatttgttaatttttgtaatgaggtgagttaattttttataataataaatttttttatttaaatatacgtatatattttttattggttttgtttttttggatgattttaatataattattttgtgaatatagtaaaattattgaattgtagattttaaaaaggttaacgttatagtatgtgaattttatttttataaagttattatttaaatagtaataagaagttggtgagttttgtgtatttttttgtaaataagagtagggatagcgtcgtttttgttttcggatgtttttagtttttagttcgagtttaggaatattttttatgtgtttttttttttaattttgtagtttaagggtgggggcggtttttagtttggtattttttttgtagttttttattttttttttatattagttaatggatatagaggtttttttatggatttttatttttatttatttatttttatttttttgagatagagttttattttgtcgtttaggttggagtgtagtggtgtgatttcggtttattgtaattttcgttttttggatttgagtgatttttttgttttagtttttcgagtaattgggattataggtacgtgttattatatttagttaattttttgtatttttattagaggtagggtttttttatgttggttaggttggtttcgaatttttgattttaggtgatttattcgttttagttttttaaagtgttgggattagaggtgtgagttattaagtttagtttttttatagatttttaaaagggttttgggtaatatagattgggatttgttaagttattaaatgatttttttaaataaagaaggaagttataaatttttatttaaaaggagtgggggatggtaatagaaatatagttagttagaagtcggaagggttttatttaatttatttttaaggtttttgggtagaagggataagggaaaatttgttttttaaatattttattcggtattttatttttcggatgtaagatgtagttgtgtatagcggtagtagtgaggattttggtttggtaggtttttatattttttgttgagggttttaggggttagggttgtttaataggattaagaggaaatgattataggagtttttagttgttgggggtggttttcgcggttttttgggttatttttggtgaatttattttaaatttggaagaggtttaagttttttcgtttttcgtattttaaattttagttacgttagttaggagttttgggggatgagaaaaaatttaattaagttttattgtgttgggtgatataggatttagaaggagaggggtttttggattgtttaagtttaatgataattttagtagttgggtttttaagttaattagtttttttttttttagtagttttcggggagtattacggtgagttgtgaggagttagtttagtacggtatatataacgtaggggttttttcgtatttttattttataaatattagggtttttcgggggattagttttttatttttgagttattttttttttatcgtttttttaataaggaatagagaaggagtttttattgtttaattagatgtagaaattgacgtacgtatagagaggttacgtgtgatatggtttggacgttgttttttttaaattttatgttgaaatgtgatttttgatgttggaggtaaggtttggggggggtggggtttgggttatgggggtggattttttatggatggtttggtgttttttttacggttataaagttcgggagatttgattgttatagagtttgggagggttgggtgaggtggtttatatttgtaattttagtattttgggaggttaaggtgggtggattataaggttaggagtttgggattagttcgattaatatggtgaaattttatttttagtaaaaatataaaaaaattagtcgggcgcggtggtatgcgtttgtaattttagttatttaggaggttgaggttgtagtgagtcgaggattgtgttattgtattttagtttggttgatatagcgagattttattttaaaaaaaaaaagagtttgggagttttttttttcgttatgtgacgtgttagttttttttttattttttattatgaggaaaagttttttggggtttttttagaagttaagtagatgttggtattatttgtatagtttgtagaatcgtgagttaaataattttttagtttcggttattttttatagtaatttaaaatggacgaatataatgtattagtttttttttttggattttatagtgtgtttggttggggttgtgttttggggaaatggtaattgcgaggtttttatagatcgggttcgggttttaattatagtcgtattttagcgttttgatattgttgagtggatgtttaaaaagtattgttgggtgaatgtgcgagtgaatgatgaagatggaggtggttgttggtgttagggtaaggttttaggagtttggggaggtggtattaggtagtttaggttaacggttaattttggatagggttaggaggtagttagaatggttaaggatagttaagggattttaggtaagtggttttattttttttaggcgggtaggaagtaggaattagattaaggggtgttaggtggtagtggtatttagggggtttgaggagtaggtgtaggtttagtagggttggtggtgttacgtgtggggtcgatcgtggtttcgtttattgtttttattttttggacgtatgggtttatggtttttaaggtttttttttgtttttacgtttatttttttaggttttatttttagacgttaagttatttttttatttttatttttttcgttgtttttatatttgagttgattttttttttgagttttggtgaaattttagagagtttagaggtgtagtttatatttttgcgttataaggtttttgtagtttttatttttttgggatattttattttagagttgggtgtgtatttattttattggattagaaattttaggaatgtttattttgtatgtttttgttttttatttttcgttcgttatttagttcgtggttgttatgtggttgggttttggtagttatcgtagttggtaatatataattagtatttttgtgtttaggtttcgtgttgagtttttttagttttattttcgtttgtttttaaaatggtttttgatatggtaattattattatttattttttagataaaagattatagttttaggagaggaggaatggtaggtttgaggttacgtggttcgtaataggtaaatggattcggtagttattttattttcgagtggggtttttttttgtttgtagatttcgttgaggttttagagtttggagttagtgagtttttattgagtataaggatagcggcggtgtcggggttggaataaggtagggaggggttttttaaattatagttttggttgtggatttattttgggatttcgttttggttgggaattttgttttagtttattcgggatatttttttattttgagttttgtattgggttgtgtacggggtttgttgaatgagtgagggtaggagggatggtgagtagggtggaaagcgattatggtgggtaggtttttgttggaagtttgaaatatttttggcgagtaggaaaatattaggggaagaggttatagtttttagaagggttcgttggggattgttttgtagtttttttatcgggataggtagaaaatttagtttttttttagggtgagtttaggaagtttgtgggggtataggttttagttagggtggcgcgtgggtttatttaggggacgttgtcgtggtttagagttaggttaaattttatgtattttgtaaataattatttataataaataaggtttatttattttttaagaagagtaaaatattataggaggtatttttttattaattaaatacgttatagtgattttattgcgttattgagggagggtattagggtgttcggtttagagtaaattgtggttagggggacgggtatattgttaaatcggttagatttttatttttgaaaatgtgggttaaattttttttaataagttataaggaaatttagtgtgaattttatgtttttattattatcggttgttttggaagattgggaggaggggttttgttttttttttatttttggttatagggtttgaggttataatttggattgggattttaattttttttttggggaagaggtttatttagggtgtttgttaaggtttagcgtataaatacggaattcgtttaacgtttgtttcggtatttttgggttttttatattgggtttttttatttgattttttaagtagtgagagtgatgggatatggggcgtttttaggggagatttggggagatggagtaagttttttagtttaaggtgaggtttcgaggtatggtttatgtagtgatgttttttacgggaggtttgaggtatgattaggagtttggagatttagtagaggtttgggtatgggattttcggtacgtagttagagcgagggtcgaggttgtatggatgtaagtaggtgattttgtgttatcgggtgttatttgtgtcgggttttgtgtagtcgtttttattttattgagttttagggaggtgaggtaattattttaggtatatagtttcgggggtaaaggttggatttaggtgtgtttgattttagaatttaagaagataagtagaggagtttgagttttttgagatcgtagtgatggtttagtgttttaggatggttaggttggtttttgtagttttagttaatcgtgtttttttttagttatttagggttttagcgttggtttttgagatttggtattggttataggggtttatttttggttgtggatatttagtgttggttattgggatttggtattggtcgtggggatttgtttttggttgtggggatttagcgttggtttttgagatttggtattggttatggggattcgtttttggttgtgggtattcggtgttggtttttgagatttggtattggttatgggggttcgtttttggttgtgggtattcggtgttggtttttgagatttggtattggttatggaggtttgtttttggttgtgggtattcggtgttggtttttgagatttggtattggtcgtgggggtttatttttggttgtagggatttagtattgtttatggggtttgtttttggtttcggggagttagtagtgtttgtggggtttatatttggtggtggggatttggtgttggaggattttgatagtaaaattatagaggcgataggtaatagtaatttattagtatagcgtgtggtttgttttagttacggtatttttttttattttgtgtttttttattataaagtttagtgtaggtaacgaagttaagaggtggagaattcgtaggaggacgtatattatatttgtttttcgtgtggcgtttttgtattttgggtggttgagattttttgttttttttttaggttttttcgtgttaggtttgcgttgttttttttggtttcggtttttatttattcggttttttagttatagatagtagcgatttttttttttatttaatggggttattgtttagtttattattagtttttagggttggtagatgatatcggttacgggtagtgtttttttcggttttagtatataaggtataaaagatattattttgttttaagatttttttagttacgtggcgtatgggaagcggtgtcgggaattttttagggtagttttttgtttcgggggagatcgtgtttaaattttcgaggaaatgttgttttttggttttttttttgaaaaattttttaaggagattttgtgcggagcgtgtagggagaatggagatttttgtgagattgtttcgggatagttttatagaaattataaattatttggataaaagttgaaaatttgcggttatataatgttgattatttatttaaatattcgttgagtaagtatttatgacgtttgggaatttaggacgtggatcgataagatataatttttatgttcgttttagtgatagagagagagacggtattattaatttcgttcgttgggggtttttttggagggggcgtgtaggtttagggttgaatttgtttagtggatgtgttatttacgtttgcgtattttttggttttgtggtggtttttggaataaaggttgagagataaaagataaggatttgggggagggaggacgtttatgtatattttattggggatattagtaaggatgattgtttagtgattatttagtgatcgagttatttggtgtttggagtttggtatttatagagtagggcgggggtagtaggttttgtcgggggtataggtttgagaagggagtgttgttagttaggttcgacgggatagagagcgaagggttttttttttgaaggttatgtagaggtcggaggttaatgttagtaattttattaacgttagttttttgagatcgatttagagttggggttttaagagtagttttgggcgtttaggagttaagattttatagagggtgttttttatttttagtttagggaaagtgataaatttggagtgtttttgtttatggtttaattattgaatttaaatgaatgtattgataaatcgtatttagtgttatttatagggaaaagggagggaaaaaaaaaaaagaaagagagttaatcgcgtttaggtcggtcggttagggggaggatagatgggttattatttttgttattttttaggttttttgtattgattttttatttttagtaaaattaaggtttagttttttttcgtagtttcggagtcggttgggatgaagtaatttttgtaggtagattattaggtttattgtgatggttttagtagggaatttagtttaggttatagtagtttaggcgtttgtagaaggtttagatttttgggtgttaagttttttttttttgtattcgtttcggggttcggtggggtgggtagtgtgcgatttttagggttgatgaaagagaggaggaagaggttgagcggcggcgagtttgaatagttaattttgggaggggttgaggtggggaaggtttttattgttgttttataggtttcggagtaaggtttttatgattttattagtagttgggtaggtataggtttaggtgttgagtgtgttaggattttcgttgttttttgggtgggggcgagagggatttttatgggtttgtaattagattcgcgtttttttagttaattttttattaaataaatttatacgtatagcggattgggtatggtcgttattttcgggagtttttttgggaaagttttttaaggttttgttgagtttcgggaataggtttttatttgttcgggaatcgggttggtatttaataaataaattaaagttcggcgtcggaaggtagaattttgggattagagttttagttaagggttataagttttttaggaagttttttttttaaagagtggttgtgggacgttgggagtttttagggtggttagtttttaggtttttttaaagtttaggtggtatcgatgttttgtgttaaggtgagggttgtagagaggggtcggcggggaggagtttttatagtttattttggttattgattttatttttaagtattgaaataaagttttttttttatattttcggttagggagagagggcggaagttttaaatattcggggtgtatgggaaaggtttatatgtatagaagaattagataacggaagttgttggtggtggtgataggttttttaaaggggttttgagatttttgatatcggtagggaagttatatattgtattaggtttgggggtagggagaaggggtttttaaggacggggttgtttttttttgtggaagtgtttcgtattgtttgataagagtagtttggattagtcgtggtataataggaagttgggagaatacggtggtttaggaggttggttagggttggggagtggttaatttagagattttggttgtttaagtgggtttagggttttcggggtgaaagtttttgtggagtatagtggatttagtgttcggaggatagattttaggtttagataaggttttttttttttttttttgagatagagttttatttttgttgtttagattggagtgtagtagtataattttagtttattgtaatttttattttttaggtttaagtgatttttttgttttagtttttcgagtagttgttattataggtacgcgttattatgttcggattagttagtatttttagtagagatagggttttattatgttggttaggttggtttcgaatttttgattttaggtgatttgtttgttttggttttttgaagtgttgggattataggtatgagttattgcgttcggttaataaggttatttttgatatggaatgttggtttgattatagtgtttgatggtttttgtttgtaattatgttttcgttttttattaaagtagggtttttagggtagaagtcgtatttttttattttagagtgttttacgttattttttaggcgtatatagtgggttttttttatcgtagttgaattggttttattattattataatgatagtttataggggcgggggttagtgggaatataaagtggttaatgtaatagtgttttagttatttcgatatagaaatggttaggggatagaaggggtaagttgggagttagtagtaatttaggtttttagagacgagtattaaaaaaggcgagttatattataggttttttttgattatattttagtttaaaagagatttaaggagaaataagaattttatttttttaataaggattcgtatattagatgttaagtaaatattttttttttttttttgaaaaggagtttttggggttgtcgggggagttggttaaagagaatgatatttatggaaatatacgtggttttattaagttttaaggtaaggtggtaatgaatggaggaggaaaatttatagtattattagggaatggggtttttttttgttttttttttttttaacgggtttttttatgtgggatttaaattaaattttaattttattttgatttagtaggtgttgtttttatagtttcgaatagatttgttagaaaattattgtttaatttgttttcgggtggtatatttttttttaggaaaggaattataaatttattttagatgagtagagagttgttttttaaatttttgattaaaatatagtagattttatatgaaaaagtaaagagagaggggttagggatgaagtgtagtaggttggaggttgagttagtttttagagttattgggacggcgttttaggagtagatggtattgtttataaagtttttcgtttttttttgttttgaggtcggggattatttcgttggttgtatgatttagtttttggggtttttttagtatgaaaagattttttgaaagtaggttcgttagggagattttttagtttttgtttattgatatgtttttgtatggtcgatacgtagtatgttattgtagagaagtaaagtatacgtagattagtttcgttagtagtatttttttttttcgttttttttaggaacgttttgtatatatttaatatatttaggaatttagagttgcgttgtagtagtagttttttggattttagtgtcggcgtcgcggggagtttcggttacggtatttcgagtattgagattatttttagtttttagttagtcggttttcgggagtttagaggggtgataatttgagcggagtgattttagagaaagcggtggttaattcgaatttttttttggtttttttggaagttagggaaattttttgcgaaaaggaaatatgttttaagaagtttcgggtagtaggagaatttagttatttagtttagttggttaaatatttataaagagatagttgtgattatataaagttttatttttttattttgaggtcgaaaatttggttttcgcgtggagatcgagtttttcgttattttttttttggggatttcgttcggttttgtcggtttcgggtcggggtttagggatagcgtggttttcggtatcgttattatggttattagggttcgtttcgcggtcgcgttatttgagagttttcgagttagtggtgtaaggttgggaagaataaaggagtaggatttattttagtagcggaacgtcgggttgcgttggacgcgtcgagagtcgcggttcgtttatcgggttatatggtttagagtcgagtagaggattaaaggggttttgtggtcgcggaataaggagttttttagagcgcggggtagaggtagggagggatttcgattgtttgggaagggaggttcggtggggaattgttttaagggggtagggcgaggggagtaggaggagggggtaggtagagataggggcgtttagcggtaggttcggcgtagaagtaatttgaaggtacgggagggacgttaaggagttgttatacgttaaaggaaagtgatagggtttttgggaagagtgagggggagttgttaggaagaagagaggggaagaggtttttagggatttttggttatgtcgtttttgtttttgtttttgtgtttgttagaggcggtgttcgtgaggagttttttttttttagttaggttttgaaattgatttggatattttttttttttgtgttttgtttgatatttttgttttttaggtgtttttttatttatttgtttagatatcgttatagttgggtttttagggagtatggttagttattttagaaagttatttagatttgtagttagggttggaatatagttatttgggtttgttttttttattttaggtgtttgttggttgggattatggaagggagaaggagtaggagaggaggggtaggggatgggggcgtagtttattttgagtttttttttcgagagtttttggatttagatttgatttagtttttgtttttttagtttttttagtttttgggggatttggttagtgagttagtttttttttttttttttttttgtaggtttgggatgtgttgggatttagaggggtataagtaagggggtttttagaggagggagttgatattataggggttgggtttggacgttgggatttgttagatttattttagtgttacgatttttgaatttaagtgagttatttttagtaggggcgtggttatttttatattaggagagagcgtttgggagtgggttcgtttcgagggtttgttgggggttgggagggatttatttaaatggaaagaagtttttggtgatattttttgagggttaggggttgaattttggaagttacgtttttaggtagtttttacgggattttatgttgagtgttgattgggttttatatatttttattttttttatttcgtatttttatacgtggttgggggtgattgaagtttcggggtattcgttatattggttaaataggttagttacgtttagcggttttttagttagtagttattggtatttgattcgtcgttttttattttttatggttaattttttttttaaggttttttggttttacggttttttttatttttatagtgaacggtcgtggggagttgttgttattggttttcgggcgttaggttagagtcgggggagtgtttgggagaagattgtatgttcggagtttttgtttttatttgaatgggagggaggttggtggtagattagagatttgggttttgagttaaatattgaaatttaaggttttgggtttgttatttaatatttgtggaatttgattttttttatttataaaatgggtattattaatattagtcgttaaaattatagtaagatatatacgtttaggttaggaagtgcggttatttagaaaatatagttttttttttttttaagaagttaatttttttagtattgggagtgagaagagtttgttttttttattgtttgtagtttagtttagggtatttttattattggtttttaaagggtagttttagaaatcgttgataaaggatgttagaaggaatttttttttggttaggtgttagggttaatagaaagtttcgaggatgtagtttttattacgtttttgtttcgtgggttttttttttttcgtgggtagaattttttttttttggttttttttttcgaatttttttttttttgtttttggttttaatttgttttttagttttttggttttttaggttttttttagggtttaagattttgtttttttttaagtttagttttttttttttttttgtttttggatttttgagttgggaggttagtattttgggtgttttgttgaggtggtcgttttttttgtagtggttttttttgttgttattaaatgagggtttttagagtatagagaaggtattttcggtttggggttgtattttttatataaagtttttgttttttagtattttttaaagttttttatcgtttagtatatatttagtatttaggtagagtagttttagagttttttcggttggttttcggtttaattttttagtagaaacggtatatgggttatagacgtaattttatattttttagtatttataataaaaaatgtaagaataagttaggtatagtggtttacgtttgttatattagtattttgggaggttgaggtgggtagattatttgaggttaggagtttaaaattagtttggttaatatggtaaaattttgtttttattaaaaatataaaaattagttaggtatggtagtagttatttgtaattttagttatttgggaggttgaggtaggagaatcgtttaaatttgggaggtaaaggttgtagtgagtcgagatcgtgttattgtattttagtttgggtaatagtgtgagattttatatttaaaaaaaaaaagaaaagaaaagaaaaaggaaattattaaaaaatgtaagaataggtgatattaattttaatattatttatttaatagagtttaaaatattattaatttaatatgtaattaatgtaaaaatgatagatatttgatattttttttttttttttttgttaggattttgaaatttagagtgtattttatatatacggtatttttttatttggaattattatattttaggtgtttaaatggtttcgtgtagttagtggttattatgttggatagtgtagttcggagagttttaatttttttttttttttttggttgtcggggaatagagttttgttttgttatttaggttggagcgtaatggcgtgattttggtttattgtaattttcgttttttgagtttaagtaattttttcgttttagttttttaagtagttgggattataggcgtatattattatgttcggcggttattttttgtatttttagtagagatggggttttattatgttggttaggttggttttaaattatagattttaattgattcgttcgttttagttttttgaagtgttgagattatacgcgtgagttattacgtttattttcggatagttttaatttgattttaggataatattaggttattagagagttgttgatttggattatattatgatttgaattttttagattattttcggtattatgtttataagttatatttagaggataataggatatagtttggtgaaatatatagcggtattttttataagatattggtgaggttatagattttattattagtgttattcgtttggggatattttatttttagaaaatgtagagttttttttaagaaatgaatgtggttaggtgtgttggtttatatttgttattttagtattttgggaggttaaggcgagtatattgtttgaggttaggagtttaagattagtttgattaatatggtgaaatttagttattattaaaaatataaaaattcgttaggcgtggtagtgtgtgtttgtagttttagttatttaggaggttgaggtaggagaatcgtttgaattcgggaggaggaggttgcggtgagttgagattacgttattgtattttagtttgggcgatagagcgagatttcgttttaaaaaataaataaaaaaagaaatgaatgttttaggtatacgttaagtattttttagacgattttaaagatattaattattgtgattgacgacgatttttttttttttttgggtgtgtttgttttgtttttttagtttataggtgtttaggatttaaaggtagttcgttataggttatgggatttggttggtttaaaagggagagtgaggttattggaatttttttaggagtgagtttgaagtttggaatgttttttggtggagggttttgaagttaggaggcgatgtagacgtgggggttgagatattatttggggttatttgtaaagagggatatttaggtagtgattttaaggaaagagtaaggggaggagagggcggtatatttacgtttttttaatttttgttcgttcggaggtttacgtattttatacgtcggttttttcgtatggatatttttttaataagtaatttatcgtgtttatgtttatttattttaaagttatatagaattgtatttattaaaaatgaatttatggagatagaaagtattttggtggttgttaagggttggagagggcgaatggggagtgagttttttatggatacggggtttttttttggggtgatgaaaaagttttggcgttagatagtgttgatggttgtacgatattgtgaatgtatttagtgttattaatggtaaattttatgttttgtgtattttagtataataaaaaaatatatatttaaagtaatagaatttaacgtgtttttttttttttttgagttagtttgtttttttgttttatattttaaaattagaagggttttgagatatattataggtttttagggtaggttgaataattttttttttttaaattgtgttattttatgtggtaatagggattttgtagatgtaattgaagatgttgagatgaagagattatttaggtgggttttaaattataagcgttttttaagagggaggtaggttaggtgtgatggtttatggttgtaattttagtattttgggaggttgaggtaggtagattatttgaggttaggagtttaagattagtttggttaatatggtaaaattttgtttttattaaaaatataaaaattagttaggtgtagtagtatatgtttgtaattttagttattcgggaagttgaggtaggagaatcgtttgaatttaggaggcggaggttgtagtgagttaagattgtgttattgtattttagtttgggtgatttcgttttaaaaaaaaaaaagaggaaggtagagggagatttgattgtagagaaggaggaggttgtaggaggatggaggtagaggttggagggatgtagtcgtaagttaaggaattttagtagagttttttatttaaagttggaagaggtaggaatggattttgttaatattttgattttagttcggtgagattgatcggtttttgatttttagtattgtaaaggaaggagtttttgttgttttaagttattgagtttgtgataagtagttatagcggtaataggaagcgaatgtagtttttagtttattttttcgtttatagtaatataggcgtttttttgtgtagaattttgttaggtagttagtgagcgggataggattttttttcgtttttattcggggttttgtgttggattttttaaggttgttgtttttgagatagtgaattttttatatttatagagatttattttaaagttgagaaagtgttttttttaaggggcgttagaaagaaggttttaaggtgtttttgttatatgtttatttgtttgtgggtaatatttatagttttttttcgtgatttatttaatagaagggttataggggagggagtattattggttagtttattttatagtaaggttttattttggaagttataggggatagttgggatttttatttttaatttagttaattgggagaagagtttagaatagttttggaggttgatatttgttaggaagtgtggtgatatttacgtgttgttgaaatatatagtaatatagtagtagagaggaggggatgtggttttatagttttttttttatttatttagtacgtacgtatatatatatatacgtgcgtgtatatatgtattaatttttagtttttaggttttgtattttgtttttgttaagtttttcggttattattaagttaggttgtgagtatagagtttagtttttttgttaatttttttttaatttattttgggtaatattttaatgggatgtagtagatgttttttattaaatgttaagagtaatatttttttttattttttgtgagttggcggtcgcgtttttgtatgggggtgcggaggaaagggttggggagtaggaatgtggttttgagggttggtatgtatttgtagttgtgacgtttcgaggtagtttatatttttatttatagattaattttgagaaggggttgggagtatttatagtttttgttatttttgggttggtaggttggggaaattttgagtagttcgagtgaaggtcgtttttaggtaggtatggtgggatagaggggtttttgtatattttttgtgaggtagcgtagttgttgggttgttttagtatatttgggtgatatgttttttttttggtttttttttatttggtttgggagaacgtttaggatgttttaattttaaaaataagtaaattttttttttttgatttatttatttttttaaattgtgaattttttttttgtttgaatagtttaattttttaaagtaggtttatattacggtttttagttttttatcgtttatttattttttagttcgagttatttggtgttcgttcgttttattattaatttagtttttgaaaaaatttttatggttagtatttagttttattttatttgatttcgagggtagtgtttgatacgtattagttggttttttttttttttttttttttttcgtattttttagtgttggggtttagatagtttttaagggttttttcgttttttgatttagttttttggagtgattatattttcgttttagttttttagtttagttgtttttttatattttgttttaggttttttttttggaatattgtttgtttttagagatttaagtttttattttttatattttttttttcgatttttagtttttttattaaagttttattggttgttttttttcggtgttttaaattagtttttttttgtttagattttataaggttagtttttattttatgattgtttttttggattattgggattattttttattaatatttattttttatttcgtttttttttgtttatgtagggttttgttggaggatttttttcgttttattatttttttttttaaatagttttttaggtttttttgttaaagttgaaattttttttttgtattcgaggatttttgtaatttggttaatttatttttaagtttgaatttttatttttgtttaaggagtttacgttttttagttaggttttattgtttcgtaaattttatttaaaattttttttggtaaatgttattatttttaggaagtttttttgatattttttattatatgtgatttttatttttagagttagattttgatttggagattttgatttttatttatttttgttttttttgagttttttaggttgtaggttttagtttatgtttgtgggtttttgtagtaggagggtttatttttatttttttaagaagtgttcgttttatttttcgttaagttgtaattttttataagtaggtatttttaatatgtttttttatttttttttttttttttttttttttttgagacggagtttggttttgttgtttaggttggagtgtagtggcgcgattttagtttattgtaatttttattttttaggttttaagtgatttttttgttatagtttttttcgtagttgggattataagtatgcgtcgttacgttaagttaatttttttttgtatttttagtagagatagggttttattatgttggttaggttggttttaaatttttggtttgaagtgattcgtcgattttagttttttaaagtgttgggattataggcgtgagttattgtatttagtttaatatgtttttttatattttttttgaaaagttattattatattaatagtgtgttttataaattgataataatttaaaatgtgatttattattaaaagtgtgattttatttttaaataatattgttggttgtggtttgtagttagttttattattttcgtgtgatgattattttgtagattagtaatggttttaggtttatatttaatttaattattttgtttttttaattttatttttttttgagttaatattaagtgtgttttagagttgtaaatttatggttgatataaaattaggatttttaatatttaatataaagtaatcgggttttgtattggttttaatagtaattataaattacgtttgttttttgtattgggtatattgtatttagtttataatatgtgtttttgttttttttattttttttattaagatggtatataggtttaaatttgttttttgggagtaattgatttttttttggaagatgtgagtagtttttatattatatttaagaagatattgttataagattttatattttttattttagtttttaagggtttatttatttttttaaaaatttatttgttttgttataatatgtgtttttttttttttatttgtttttttaagatatagttttattttgttgtttagattggaatgtaatggtatgattttagtttattgtaattttcgtttcgtgggtttaagtaatttttttgttttagttttttaagtagttgggattataggtgtgtattattatattcggttaatttttgtatttttagtagagacggggttttattatgttggttaggttggttttgaattttcgattttaggtgatttatttgtttcggtttttcgaagtgtcgggattataggcgtgagttatcgtattcggtttataatatgtgtttttatttttttttttttttttattaagatagtatacgggttttaagtttttttttttttttttttttttttaagattagttggttgggtgtagtggtttatgtttgtaattttattattttgggaggtcgaggtaggtagattacgaggttaggagtttgagattagtttggttaatatagtgaaattttgtttttattaaaaatataaaaaattagttaggcgtggtggtgggtgtttgtaattttagttattcgggaggttgaggtaggggaatcgtttgaattcgggaggcggaggttagagtgagtcgagatcgtgttattgtattttagtttaggtaatagtgtaagattttgatttaaaaaaaataaaataagtgggaagaggggagatagtggaataaggagtttaatttgtaattgattgtgaataattaattgagataatttattattttcggattagttacgggttttattttttatttgtttttttgagttacgttttttagtgaaattttatacgtatgtgattaaatttgtttttttttttattaatttattttgagtgagtttaatttatagatttttaaatattgaatttaagagggtagaggaaatgtatttttttttcgttataaaaatattttatttttttattgtagtgtcgtttgttttatttatagtcggtaatttggatttcgttttttaaagtttatgaaagtaggatagattgtttgtaggatgttttcgttataaaaggagggttaggtttggtaggaggaaagaaacggaagtggtaaacgtttattttttgcgttagatagaggtattaggtgtttattgttttggggagtaaatatttttaaaaacggaaagaaaaatttttagttttattggggtgtaaaaagttatgatttttttcgtggttaaatggttgggtggtttgggagataagcggtagttattttgaagtttagtttatttgtttgtaaatggagggtaatgaaattatttgttgtatgggtgtttgataggttgttgtttaaattttttgtttttttttatggggttttggggaagattatatgagttagtaatataaaagtattttgaaaattatacgaagtgtttaagtatgggggcgttggttgattttaggtttgtttttataagttggtagaaaattttttagagagggttttgttttttttttcggggtaggggtcgtagtgttagatttgatggtattggtggttgtttaggttatttggtatgagattgttgttagttttagatttattttaagtttgggagggaagtaggtcggggtgggggttttgaaattttttatatttttggtagagatattagggtaggtaaaagtgttatttatggtaaattaagaagtttgtttgaattgggtttaaattagtttagtttagaatggaggttagttttattttttttttttagaattaggagtttagtatattagaggttgagaaaacgttggaatagtttttttatttgtttgtttagagatagggattttaagttatttttttttttagtttattttataaattttttgtgttagattttttttgtttaggagttataggttttatttgggagttatttagggttttaaggtttttattatttagttgtttattttattaggttaggtttgtaggtatggagattagtaggatgtggtttaaatttggttgtacgttgattagttgagtgattttgggtttattttttaatttttgggaggtaatgtttttttatttgtaaaaaggggaaagggtttagcgaggagagtgataagtaaaggagatggtatttgtgtagacggtattgtgcgggcgtttagcggatgattacgcgttatttttttgttttttttttttgtttttgtgggagcgtgggtagtagggagttaagaggaagggagtagttgttcgtttgggacgtaggtcgttttgaattggaagagaaaaaggaataagtagtagttgtttattgataagttttatgtatttgtgttttaaaattttaaaggtgtatttgaaagattttttgggtaaatttttttttatagatatacgaaagttaggtgtagtggtttacgtttgtaattttaatattttgggaggcgaaggtaggcggattatttgaagtcgggagttcgagattagtttggttaatttggtgaaattttatttttattaaaaatataaaaattcgtcgggcgtggtggtgggcgtttataattttagttatttaggaggttgaggtaggagattcgtttgaattcgagaggtggaggttgtagtgagttaagattgtgttattgtattttagtttaggtgacggagcgagattttattttaaataaaaataaatttaaaaaaaaggtatatgaaaaaggtaaaatgttatgagtgttttgtcgtaatgtgttagttataaatgggaattggaggattttttaagttatttttttttttattttttttttttttgtatatgtattaatagttttttgggtgttggtagtattaggggatttggggtgttttataggttttgtttgtttagattttagagttaaggaggagatataaaagttaaaatagggtggtaagtggaataaatggggattagatggggtaatttggtagtattcggtaaggttttttttaatgagtttttaaagaggtttagtttttaggggaaggaggcgttttaggtagcgggggtttgtagaggcgaaggtttagggcggggtttttagggaagtcgtttaggatgttcgaaaggaggggagtaatttacgagtttggtgatagggtcggttataaagtgttatgaagtattaattaggttgtttattagtttttaggatagaaagattatagtagttaaggtgtggggatttgtttatttgatttttatttagtttagaaaatgattgttttagggttataggtaatagtttaagttttgtaagttgttggttatagggtgtagttgcggtaaggtggggacgtttattagttaagttttttaggatttttgggttgtcggatatgtttgtaggacgttacgggggtaggttagattaggggtatttttatttttttttttaggttttagtttttaggttagagtgttttttggtttttggggtttttagggttgtagatagatagggagaggtttgtgttatggtgggttatttggtttttgtaggaagtggttagaggttttagtatttggatatagtagttatttttttaatttttgttaatgttgttgttgttcggggtttattttttttaatttttttttttaattagggaggaaagtattttggagtaggaattgggttatttagtttgatattttagtatgattttgtatgattttgggttagttatttaatttttttgggtttttatttttttatttgtaaattaggtagataattttttaaagttttttttagttatagaattttaagtgttaaaataaaaaaaatttataaaaaggaaatatgtgtttagtttatattttcgtttttatttgttaaaaggggaaatggatttgttacggggttttttttttttaaatagatatgggagattttttttatgattgtagaattggagtagtttagaggagtttagaattttttagagtttgagatttataggggaatttattttaattttttcgggatagaagtattgttgtttaatggtatttaatttttattattgttgtagtaaatgattatatatttgtgatgttaaataatatagattagttttatattttattttattaggttatagggaaggtgtttatagggttgcgtattttttcgaggttgtaggggagattgcgtttttttgtattttttgtttatttgtattttttggtttgtggttttttttttttttttaagttttttttattgtattttttagatggtttattgcgtttttaaaaatttttgtgatgatagcgggttcgtgtggattatttaggattatttttttattttaagattagttgattagtgattttagttggttttgttatgttatttaacgtagttttaggtgttggggattaggatgtgtttaattttgggagttattattttgttaattttaagatataggttttggagggagatgaagggtaggattataggtttaggaggttgtttgcgtgggttcgaattttggttttattattaaggaattgggggagtatattatttgtaaaatgggggtcggcggggaattagttttttggttgttagcgtagagtgaggtagtgtgtgtagtgtttggagtagtttcgtgagtatttgtttttttttcgttaaatttataagaattgatttcggtttaacggtttttttaaatttttagtttttttcggttataaggttaggagtatttttttgtagggttatttaagtttttagtttttttgaaagtttcggtttatacgatgttggaagtagatgtgtcgtgggttgtttatttatgtatggttatcggagaggttcggatgatgtcgtttttaatgggtgtatagtgtagggtagggttaggtattaataattagttatagttattagcgtaagtaaggggtttttattgttatttttggtttggggttagggagaagtttcgggaggtatttgatttttttatagggagtggggttataggagaatgtattcgaaaggggttggggggtagtagaaagttttttttagaaattttatttttggttcgtgatagatgatttttttaggttattattggggtttatttgggtttttgtagtatggagtttggttattttagaaggatgattgggtaggttagggttattggcgatggtgacggtaggtttttttgaggtttttttattagaagtattaggaggttagagtagtcgataagtttttatttggtttttgaggggtagaaggttttgagtagttttttgatttttcgaggtttttttattttattgagagattttcgagagtattgagagttattttttggttttttcgtgagagagttggttatataaaggtagttatatatttagtaagatgaatttataatttttgagtttaggtttatttcggtttttttatagggagtttttgggggcgtggggtgggggtgtagaagggaggggtcggtgttttatttttgggaattaggttatgagttttggatttaggttaaattatagaggttttatttttttttaggttttttgttttttaattatttttgtatagggtatttttttttttttcgtagggttttattggggtggggtgaggaggagttatagaattatagtagttgttatacgggggtgttaaggtagggatgttgatgttaatcgaatgggtacgggaaggtagagtaggaggtcggcgttttgggtttggttaggttgtgtgattttagggaatttattttatttttttcggtttttagttttttttattgtaaatcgagggagtgaggttaggtgatttgtataatcgcgtgaatttgtgttttgtattttttatttattattttaaataatgtttttaaattttagttttttaatgtttcggtatttttttgtttgagaaatatttacggttgttttttatgttgtgttttaaatataggtattttggtttttttttgggtgtttttattagggttagaatgggtagtttattttgtaggaatttttaaggatttttagttatttttaggatgggggttggttgttcggaagcggtttttgtttattttcgtcgtagtttttattacgaggttagtgtagtaaaataggaggtgtaggtggtcggggttaggggttaggttattttttttagcggggtaggagaggggcgagaaaagttggatattgattattttaggttgagggtttgcgtggaggagggggtttatggtaaaggaagtgggaggatgggaaggagtttttgttggatatttttatttcgttggttttagtttcgttttcgttttatttgcggggagaaagtgaggttttttgttttgttaaattttagtaatgaattttatatttattttattttttgtttattggaaattttttttttattttttggattcgttttgaatagttgggttgtagaagtcggtggaatgaaatatgtagggtggtttagaggggattgtgtcgaatagcgttgtgttttcgtttatttttttttttgaagataaggtttttttgtttttgttttttttttgggaaagttggagagggggttgaggaaatgggatttattattaattttttcgtgtacgttggtttttagtaggtatttttatattttttaattaggttcgtagggtggaaaggtagtcgtcgagtttaatttaatttttatttagtcgtggaagttagtgtggatggtaaagtatttatgtataaatatatatacgaggttgaggttaagagaatacgcgtttagtttttttttggttttttagtaacgtttttatgttttagttttgttttaagttttaaacggtgtaaggtttttttaggtggaggaatggaagtttttaagaagttcgtgttttagggattatatagaggtagggtttaggagtaaaggtttttagatttcgtagtgcggcgttggtaagtttgcgttgttgtatttatattgttttgggatgaaggcgatatgttgattttttttaggtggttgtaggatagttaggaggaggtgagatgttagttaaaggtagttatagataatagtattacggattattagaaacgttattttcgtgttaaagcgttcgttttttttagttgttttattttgtgttaatattttttgggagtgatatgtgtgagattgggttgtgttgatgagtgattattggtatttttagattatattaaggaggggttattttgttgttaattaggtgtagggtaggcggtattggggtacgacgattcgttcggtatggttgttttatttttttttttgtttgagtataggttggtaggtttagaggagaggaggaaatagagttattatggggggcgtgtttaggggtgagttattttaagaagttatagaattagggtatgggagatattgtttagttttgttattaatttgtcgtgcgaagttggttaagttattgtatttttttgggttttaggttttgtaattagagggttggtcgaagaggtaaatgatagtggttagggatgggggtattgaagttagatttttcgtattcggattttttttttgttatgtttagagggaggtttgggtaggttatttaatatttttgggttgtgggttttttatcggtgaaatgggaataataatagaattaattttatagtgttgttgggaggattaaaggggatatttattttaggtaaagagtttttaagatagttcggggtttttaggaagtttttgttattattatcggatattattatttttgttacggttgttagggtttcgtttagtatcggtagtttgatgtcggtagaggaagggtgaggtttttgtttttttgtagcgttttttttttttttttttttttagttatggtaataatagttgaagtttatttttagttttagcgattggttatttttttgaattaaggattgaaggttttaggtttgttatttaaggtttaggtgtaagaggggtgagttatcggtttttgtttttattatatttaggtttttatacgtttttttaaataggtttttgttttacgtgtaagagaagatgttaatttttacgtttggggcgggggtgtttataaatgttttggacgtgagttttgacgggggttatggtgtaggttttgttagggtatttttaattataggggattatttgtagtttatagagggttttttgtaggttaatgggattttgttattttggttgttattttgtttagttatttggtaaggaaaataggttgtagatttagaggtagtacgggtttatatgttagcgagataatataataagggaaggatgtgtaggacgagggagttatggagattttatcgtagttttagttatttattagtagattttgtgcggacgtcgggtaggttattttattaatttttaggatgtttttgtaggttttgcgggtggatagggtgaacggaggtataaggagggtaagtttgataggggttggggttgggtttggagttagaattttagttagttttgttatcgtattttagggtatttttcgtagatagtaggttaaagtaaggttgtttagattaaaggggaaggggttttgttttttttattaagggttttttggagattttaatatagatttttagtttatagatattaaatttagggtttttgagaagtgagaaatgtgaaaaacgtatagaatagttgtagtttagcgtttttaatacgttagatttatataggtatatatagcgtttttgtagaggttagaaagttttgtgttgggaagtttttcgatcgggggaggttttatagtaagtttttttttttgtttatttattaacgggcggaaggttttaattaggattatatgggaagggttagcgggaggggtagagagggaaaatgaataggtaatattaagtgtttggggcggggggcgtaggggatatttaggaggggagggtaggggtgtattttttatttaatttatagggaacgggggttcgggaggtgtaggagaaggtttcggtatttttatttttttttttttgtagatttatttatagtttgtttacgggtagttagatttagttataggttagacgttcgttttagttttatttttttggtttattgaaagtaagttaggatagtgagggggacgatgttgttattttcggtatggttatgttgggtttcggggtgggtgggaacgtggttggggcgttattttttttggtcgttataggtataaaagttttttcgtgttttagtgttatatgtgggttttttttttgttgttttaataggacggatatttaagtagattttgttggtcggggggggttttcgtatttagttttattttgatttagcgaattttttttttgttttttggggtaggagttattaggtcgggttttaggtaatggttagtgaaggggttgtatggaggggttttttaggtttataggaagggaggttttttttttttgtaacgtggttgtagtattttgtgatcgagagggatattacggttggagatggtgggatggaggattttttatagtattttcgatgtttagaatattttattttgtataaaaaagttttaaatttttttgagggttgaagttatttagagttggggtttttgttttttaggttaaaagtattttgtcggagtagttgagagtatagcgggaggggaggggtaggagggaatagtttcgttacggcgataggggattttttgattttaagagggtttgtagatattattatttatttttagttttgaattgttttttgttaaggggttagaaatttttgggagggggattatagggggtttcgtttatgagaatagtgattgtggttaggttatagtttataagttagtaattttgtttagtcgtcgcggtggtttttttttgatggtttttagaaaaagcgttttattttttgttattagtgttttgaaatttaagaatattttttaaatagtaattgtagtaaaagttaatgttgcgtgagtgtcgtaggtattatttttagggttttatatatttttcgtttagtttttataaaaattttattttattttttttttcgttttttttttttaatagtttagaaaacgagtacggaagggttaagttggtttgaggaggggttggtggaatagtttgagggtttagtttttaagaattttatattgtaaagggaatttttgggttagggagtagggtatagtttttatttttttattttcgtttttagtattaggtttgatatagacggggtttcggttatgaataaatgaataagtgaatgagagtttgttgagggaagaaggtgatagggataagggagaaataaagtagttaatgtcgtcgtgatgatgacgatgttaacggtagtattgatatgtgggtttttgttatgttaggatcgttttaagtattttgttttatgaatatttttgttttttattatgtttcgagtggatatttttattagtttattttatagaggggaatatagttgagcgtattggttaaggttatgttgttaggaaaggttagagtttaggtagtatgtggttttttagtcgggttttggtttatacggttttataggtagttttatgaaatacgtagagagagtatgtgaggggtttttttgttgttttttatttttagttggggtttattttttgttgaaatttttttaatttgtttttaagtttcgttagttacgaaatatttttttgaatatttagtattatttttttatggttatttggttttatttttttatagggtaagttttgggcgaaaagtagaaaggatgaaaatttttgagagaggtgataacgtggtaatttttttttttttttttttttttttgagatagtattttattttcgttgtttaggttggaatgtagtggtacgattttggtttattgtaatttttatttttcgggtttaagttatttttttgttttagttttttgaggagttgggagtataggtatgtgttattatattaggttaatttttgtgtttttttgtagagatggagtttcgttatgttgtttaggttggttttaaattcgtgggtttaagtaatttgtttgttttagttttttgggattatagacgtgaattatcgtgtttggttgaggtggtttttatataaagtagagaaaattatttttagtttaaaataaattaataagtattgagtgtttatgtagaaaaagattagaaggaaacgtgaatatgttaatagtgtttgtttggaggacgtaattattattgattattttttttatattttttaatttaattattttgttataagtaggtgtgatttttaaaattataaaagataaacgttggttttttgtttgtgttttgttttttgagatagggttttattttgttatttaggagttggagtatagtggtgtggttatagtttattgtagttttaaatttttaatttaagtaatttttttatttgagttttttgaggagttgggattataggtaagcgttattatttttagtatttttgttgtttagattggtttcgaacgtttggttttaagcgatttttttatcgtagttttttaaagttgggattataggcgtgagttattacgtttagtaaagattgttttttaattaggaagatagatgttttttagtattttttgtttttttttttttttttttttttgatacggagtattgttttgttgtttaggttggagtgtagtagtatagtttcggtttattgtaatttttgtttttcgggtttaagagatttttttgttttagtttttagagtagttgggattataagcgtgtattattatatttggttaatttttgtatttttagtagagatggggtttcgttatgttgattagtttggttttgaatttttgattttaagggatttattcgttttggttttttaaagtgttgggattatatgcgtgagttattattttcggtttgttttttagtatttttaatttttgttttttggtattatttggttaagtagatgaaaagttttagtgagttgttagtcggtattaggttggggttttttttaggtagttttaagtggttaggatttggttttttttttagagttgggtttagaaattaagatcgggaatgcgtgatggttgttttgcgggtttttgttatgaggttatttttttggttttagtgatcggtcgttggttgtagggagtatgtgggtttagttagggtttgtgttaatatggttttgttttatttacggtttagtgggtttttttatttttcgttgtatgataattttaggaaaaatgttaggagggagggagtcgttgggggtgtgataggagagattttttagggatagatttgtaaaaattgttttaaagttttttttaaggatttttaaggtttttattgttttttattgataggttacggttcgggtagagaaagttggggatggagttggcggggggagggtggttagtattcgtaaggtaaggagatgagttgggagaataggggttgggagggtagttttaggttagtttttgtttttagaattattgttttttttttttggttataaagtgaggttggttagatataggtttattttataggttgggaggttgggcgtgaaagtattgtgtttgtatggggtattttatggtgaatattattagagttaatttttagggtttgttgttttatagggaagttagtgtaaggcgtttatggaatttagaagtatttaaaggatttgatagttatgagttgggaggatttagttttgtagtaggagaaagagaggtagagagataggtttcgtaatatttgttttattcgttgtgttgttttgagtatagtttatttttttgtggtttcgagttttagttttgaggtttttaagattttttgggttttcgtagtttaggatgtttatttgaaaattaggtttagttagtagggtttttttcgttagtttattattggttagtttttgtttagtattttttagtttattatttttatttgtgtaaattttatattagtattttaagtttttttttttttaggaaggagattgtttttagatgtgttttttgttttttttcgattaaagtttagaaaataggaattagttttgcgttttttttttttatcgaattgttggtttttttggatgttttttttgattttttgttaatatttttataatataattagtttttagtttttttttaaatgtaatcggcgagtacgttgtagtttaggcggacggtgatgtttttattttgtaatttgcgagagttagtatattttttagttaggtgggttgtaggagttagtcgtggcgagggtaggaggtttgcgtgttgacggtatcggtattattaaaattacggttagattaaggttacggttaacgagtttttttatttgtaattttttttttattaaggtggttttagttttagtttcggttttagttttggttttggttttaggagttgtagatatatttttaagtttttattttaggagtttggttttatatatatcggaggatacggagttggggtataaatagttaagaataggtatatttgtaattaggagtagggggcggagggttgttgagatgtttttatttttatcggttgttttttttgacggtttattatttattatatattgattgtataattagggttgtgatatgtttgttttttatattatattattaaatttttaaatttgtttttaatttatatacgatgaggtaaatttagagttaataatttgtttattagtttttgaatttatgggtggttttaatttttttttttttagtttttttgggtttatatgagtattgaggtataagggaattttattagttgggaagtgtgttttttttttgttgattttatagtttttttagtttgtgtttgaagttgttaatatttttttatttagtattgttttttgtagtttgagttgtcgttgtgtgatttagggttagtgttttaatttttttggattatatttgtaagatgaggatgtcgtcgtatagtttattttaaatggttattaagttgtttgtatagttaatatttgtcgagtttgtgatacgattagttttgttttaatttcgaatgtggtatttttatttagtttgggggtggaattgttagtttttttttttttggataaggaagttgaaaggttttagaaggtattaaggttagttgatttgttagtaggtatagtgtttatttgttatttatagtttttttttgatcgtttcgtttgtttttttagttgagattttgtgtgtatttgaatattttgttaatggttgaatttgtattagggttattgtgttagttgggtttgttaggttatcgttttcgagttttgtttaaggtagggttagtgtttatattttgtttttttgttagtgttttatttaaggttttggaaaggttttggagttagagattcggttaaattttggtaatgttttatatttgttgtgtgattatgggttagcgatttagtttttttgtgtttttcgggttgttgtgagggttataggagatgtatagagggttttgagtttggtggttggtatgttgtaaaggttagttacgtggtgtaaggatggtattgatgataataaatgaatcgaacgaaaattaggttaattgggtttggggaggggcgttggttaaatagattcgagtggattaggattttgtatatgatgagtaagcgggaatagttttaaatagtaagtcgggtaggtttaggatgatttagttttgggtgttgtttagggttttttttcggtttttttgtcggtttggtttttttttgttttagtttgattgtttttatgggttttaataagtttttgattaggattgaggtagaatagatagggtttaagattttgtaggtaggtatagagtgtggatggtaaaaggagatgttttaggttttttgtcgttttttttttttcgaaggttgataatgttaatttatagaagaagttgtttttttcggtttcggattttattttaatatagtgtatgaggtagttgtgtttaaggggtgtgattatttttgtagatggaatttatttattgtgtttagtttattgttagagttcggaggacgggggaagtgaggtggggtattttttatagtgaagggaaaatttagtttagttatttttttttgtgttgtttttggaatttattttgttatggttttattttaatttagttttttaaagttttagagagttttgtttttttttttgtattttatttcgtttatttgtgttgggttagttttttagaagtttcgttttttgttatttttagggtattaaggttggttggtgggtttagggatttttattttttgatttagttttagtggtttattttatatttatcggtatttataggtgtgttttttattttcggtttttgtataggcggttttatattttgggagtttagttttttttaaggatttacgttagagtatagggatttttgtttttgatttttttttagttttaattacgagtagtttatgttatagtaattttttagttgtttgtagttgtttgttaagttatgataatggtttttgttttttaatttaatgtttgtatatagataaatcgttatattttaagtagattagatattattttttttaggaagttttttttgattgttttagttggatagaggttttttttttttgtgtttttttaatgtttaataggtatttattgagtattcgtgatatgtaaggtatttataatataagttagtgttttttgtttttttagagggtatatgaataaataaacggtaagattttttaatatttatttatgttttatagaaagttatttataggtatgggagggttgttttaattgcgggtgatagggaggtttttttaagatggtagcgttttagtaagatttgaatgaggcggttaggaggtttagggagggattttttaggagggaataagtgaatattttttcgtgaggatgagtttttatgttttaggagtagttaggttaggggatcggtgtagtgaataggggttgaggggagtggttaggtgacgtagggttttataggtcgttttacgatgagttagcgttttaagtatagtagatatttagggaaggtttaggttggggagtgatttgaatagattttttatttaggagtttatcggggtttttgggtttacgttgttgcgttattgtatgttttcgggggttcgggggggtattttttatattattattataggtagtatttttgggggaggtgtgttgtgtaggggattcgttggttattttgtcgggtaaattataggggattgtgtaggataggcggttagtttaggagggataattatttaagtaggggttagagggtattcggattcgggaggagtgtttaattttttaggtttaggtaattagaggtggggggcggggtgttgttttttgatatgggaggtttgggggtttggttgtattttttggtgtggaggtgttgggaggtgtggaggtttttttttgaggttgggattttttggttattttgatttattgtttcgattttattttttagtttgagggtatggtttgaatttatagtcgtatatatttttttttgtatagggttttgcggggtcggtatagtagttttttttttatagattaggatgtttagttttaggagggttgggattgtttaagatcgtataattagggttagatatagttgggttaattttgtgatttttggttttacgtatagattttaagtatataggtaaaattttgttggttgggagggttggggggtagatgagcggggggtagtttttttttagttttttaatatgttaggtttttgggtgggagggggtataaagattttattttttttaagagatagagaaagaggtagtggagggtttttttttggttgaggttttaggttttgagtggtgaatgtaattttatttggaggttggaagttaggcggttttgggggtgtgcgaggttcgttagtttagttgtagttttttttatgtaagggaattttttttaggtagcgtttttatgattagagagggggttaggaagaggtgagggttgtatttagagtgatattcgggtgggttttattttggggatacggttatatttttttttcggatttttgaagtttttaggtgcgggttaagggtttttagttgtaggtaggagagggttttatagttatagatttggggagtttagtttgtaaagtttagaggttttcggaggtcgttggttcggttttttgtgtagttgggtttttttgggaggttttttttcggtatttttagtttttagttcgtacgattttttatagttgggtttatttttttaggttcgggttatatggtgtaggttagtggggttttgggggagggtagggcgttaggaatagtttcgggggtggggggattggagtagagtttattttggtcgtttgtttattttgtatgaaggacgttagatttttatatgtggttattcgatttcgtttaattatgcgtaagttttggttatttttattttattgatgggaattaaattggttaaggagaagtttagaatttgagtagagtaggggtttaagttttttaggagttttaggtattttttagttttttttttcgagtattgagtttatatatttagtgttcggatgtttatttatttgggggttcggcgatcgttagttagtatggtttataaagggtttttgtgtaataggttttatttgatttttttaaaaatttttcgaggtaggataatgttatttaatttattttatagataaagtaattgagttataaaatggtttgttaaaagatatagaggtagaaagattaatagtaaagagtttttttgtgattttgattagtaaggtttttagaaaaaagtaagggatttcgaggtttttataggaatagagttttggaggagaataagagtttagttttatgttatttttaaggggtattttgaaggttaaggtattgggtttaagtaggttggattgtgttttttgtattttttttattttttgaagtttttttttttttatttaggtgggtcgtggaggtgtttataatatataatggaatagttggtaggttattgggttttttattgagttaaggggttcgattagaggtttaaatagtggtatagaaattatgagtttcgttgtaaattagtttaggttttggagttaagtagttttgtgtttatagttagggttagtcgtttttagttgtgtggtttgaggttagttttttaatttttttgtgtttcggtgttttttttgtagtagtaataggaatcgttttttacggcgatagtgtagatatattttatgaagcgtataaagtttcgagtttagcgtttggagtacgttaggacgtagtaagtggttatttatgatttatgaaatattaataaggtgaggggtggaatgatagtttttttgcgttgtttttaaaatggaaataaatttgtttagcgtttaaagtagtagaaagtgagttaaggataggtttttagcgatatgttttggtagagtgttttttgttggttttaggtagggtttagggcgggcggttattttttagatgagtttatcgttggtatttgtttttagagtatatgtttggattttttagatttttttttttttttttttgatttttttttattttgtaatttttattttttgttatttttttatttattttttttttttatttttgtttaaaaataaataatggaggttaaatgtgttagttggttttttggaaaggtttttttgtagtaggaacgcgacgggggtagtggaggattgtttagcgtaagttacgtgattttcgcgcggagtcggggaaggggaggcgttgagatcgagggtgttaggatcgaggtattgagatggggttattggataatggttagggttagttttcgtttttattttaataggggtttttatatttaggggttatatttttaaagttttttggataagagagataaattttattatagggttagaaacgttgtttttaggtcgttatttgggtgggggtgagagatgtttcgtcggtttttaaatatttattttgtggataaaattattaaggggaatttaatgtttttatagtagtttggttaagatataggtattaggtcgggcgtagtggtttacgtttgtagttttagtattttgggaggttgaggcgggcggatcgtttgaggttaggagttcgagattagtttggttaatatggtgaaattttatttttattaaaaatataaaaattagttaggtgtggtggtgtgagtttgtagttttagttatttaggaggttgagataggagaattgtttgaattttggaggtggaggttgttatgagtggatattatattattgtattttagtttggatgatagagcgagtaagatagttttaagaaaaaaaaagatgtaggtattgttttagggtttataagtataatttgatttttgatgttggtatttaattttgatgtagattttagtaggaaaagggagacgaattagaaggttgtggggacgaggggtttatagtagtgtttattagatttgttttggtaggtataagtgttttttggaggttgttagataagtagagggtttattttagagattttggttttggagggttgggttagggtttaggaagttgtatttcggtagggaatttagagttattttgagttttattttggaagtaagagttagggggtagaatagaatcggaattaaaagtttttgtgggtttagttttatggggatgggttcggttttatggggatggatttttgtattattcgaggtgattattagttcggtttttcgggattagttttgagtgttttttggggaaagcgggatttgtagaggatggttttttaggattcgtttgattatttatttttagttcgtttttattttagtttttttgatttttattttttatttagaattttggagatttggttttggaggtttagagattagaaatgaggggagataaggggagaagtttttttttttattcgttggttacgttaatgggttgattttttaggaagttatattagttattgttattgttttggtcgtttcgtttggtttcgaggttgggtgagtaagtatttcgttttgtttgtttttttatttgagttttttgttgatgttacgagaggtttgattacgcgtttaggaggtataggatagagtttagagttgtttaagaatatataaggttgaggttcgggttttgtatttgggaagggttaggaagggttaaaggaaaattttagttgagtataatggtttatgtttggaattttagtattttggtaggttaaggtaggaggattatttaagtttaggagttggagtttagtttgggaaatatagtaagattttatttttataaaaaaaaattaaaattaaaaaattaattaggtatggtggtatatatttgtagttttagttatttggtaggttgagatgggaggattgttgagtttaggaggtcgagattatagtgagcgggatattgggttattgaattttagtttgggcgatagagagagatcgttttaaaaaaaatttttatattttatggagtttagtagaattttcggttagggtgtttcgattgtgaaatgagcgtggtagttgttaattttcgagggtgaagatttatttattagtaatttgtattttggtacggtgagaggaagtgtttggggaaagacgtcggtcgaggtagagagtttagtttaatttatcgtggaggagttattttagttttaaagagaaagattaataaattttaggtgaatggtttaaaagttatttttgtatacgtagagggtgtattttgggatatgtggatatttttttttaggataggaagtaaaattagtaggtagagacgtgagtttttttgtttttgtcggagttaatttggagtttttatttcggtttttagggaagtatagatttttatttttatcgtagttaaaagattttttgttgatttttttagtagtatttagtttagttttgtggggagaggcggtagggggaggagatagagaaagatgagtttttggtagttgtgattggggggagagaaatgcggttttaatttgtttttgtttattttatagacgggcggtgttttattttaaaatttagggtagttgagggattgaaggaagagggggatattttttaattggggtttttttttattttattttatggcgttttatataggaaagagttggaaggtttcgggtttttggtatttagttaaagttttaggtaggggtttagatattgggttgtgttattattttaggtagttcgggagttagcgacggtagagttttatttttatttcgattattgtatagtatttcgtttttaggatagtttagtagttaggttgttttagggtttaaatttagatatttaattgtgggggttttaggtaagtggttgaagttttttgcgttttgattttttaatttggaaaatgggatgatgaaagtaattgttgggtagggtaaggggtaagtgaaagttagcgtttgagagtgatgtggttaggatcgttgttgtgattatatattgagttttttttttttatttgagataagggttttattgattgttgttagaaagatttagatttagaaggattaggaaagtcgttttatttataattttagagggaaggggaggttttcgtgttagttggttgttgtaggggagagggtgggagatagatgggggatagaggagtaggggtagtaggaggaacggtcggtagggaagttcgtttgagatttaaaggattgtttattaggaggatagtttaggttttttttattgagaaagatttttttggatagttgggttgaggatttttaggttttttgggtggagtagaattagttattattgaagttatataggtttgtaagtataagtgggggattgtttaggtatttttgttttataggggttaggtattaaggttagggtggttagaggatatgacgtagtttagtaggggtttcgtagaattattagttaagaagatatatgtagaagtacgtaagtgtttcgaggaggtaaattttttgttggattgaatatggggagttgagtttttaattattgagtcgggttgttcggttcgtttttttttttttgaatagaaggtttttagatagagtagttaggtaatagtatggttaagtaggggtttgtattttagttttgttttgtagtttgattaggttgtcgtttttttaggagatacgggattggttagggtttttttaggttgttataggaataaggtagggttgtgattttttttatggtttaggtatttgggggagggattatgagttttagtttaggggatagataggaaacggatagttcgttttttttttaattacggagttggttttttttttatcgtattttttttagttatgttttttattagaagattatcgtatttaatgggtggttttgtagcgatatttagtttaatgaagttatttggtgggggttttgggggatgtagttttttgaaatatatacgggtagtgggtgagtcggaggttgcgtggggttttgttttttggggatggttaggaggtgttttaattatttgtaattcgagtttatagtgatcgggatttgttgtttttttattttagtttttttttattagtattcgttaagcgttagttagtaggtgtcggtacggtttaaggtaggtttgtagttagattagtatcgggggagggatcgggagagagatttttagagtggaagttatagttttttttttttttaggttgggtaatagattattatttttagttagttttggggaagggggaggggttagttgggtcgtaggtatagcgttggggttttttgaggtggttgttgttgattacggttttttttttttttgggttgggtaatagattattattttcggtttattttagggaagcgggaggggttagttggggtataggtatagcgtcggggtttttgcggcggttgttgttgattacgggtttgttattttttttttagttgggttgttatttcggttttgaaagcgttttttttagtttttaattcgtgtttaggaggtagtcgatattttaagcgttgttatagtaggaggttgggtttgtaagtgtgattcgtttggggaggggtagagggaaagattattttcgtttaaatagcggtttttttttttttttcgggggtttttatagggtttttagtttttttttggttaagaggtaaggagaggtaggaaagttttaggaatatcggtagagaagagatagggtaggttgttagaggaagtaggttgtagggtgtttaaggttttaggttgggttttgggaggttagggtatgggtaattaggaggtttaggtagggaaatttgtttcgtagggattttgggagataggggagaggggatatgatagtcgttttttgttgttttttggttgtggtttttaggggttttagtttagattagaagtattttatgtatcgggtttcggtttagtttggaagtacggtttatagatttatatgattatttgggtagtgatttttaaaaggtttttcgttattagttggggagttttcgaggggagggtggttttgtagagtatttggagatattaatgggtcgtgaggaaaggaggaggcgtggatatttttacggttttaagagaaaattaaggtagagttggaggttgggcgtggcggtttatatttgtaattttagtattttgggaagtcgaggtgggtagattatttgaggttaggagtttaagattagtttggttaatatggtgaaaatcggtttttgttaaaaatataaaaattagtttgttatggtgatacgcgtttgtagttttagttatttaggaggttgaggtaggagaattgtttgaatttaggaggtggagattgtagtgagttaagatggtattattgtattttagtttgggtaatagagtaaaattttattttaagaaaaaaaaagagtagagttggaggttaggcggtttttagagtttgataaggaggtcgtggggttgggttgttttttcggttatttgaggggtagggattggtttagtttgagttttagatttataagaggttgaatcggagcgggatttcgagatgaggtagggttattttgtttatatttgtgtttaggttttaatagttattttttttaggaatttagtttgatggttttttaggttgagaggttgttaaggggttgtaaggtgtcgtaacgtgtgagtcggtgggttttgatgtgtgatagttcggggtattttttttatcgttagggaataggaatgaggagttttttatttttagtgtttggtaggtaggaggtcgttattggattgtgtgtttaggtgttattagatttcgagggtttacggatacggtatatgatttttaatgattaacgtttgtgtagtaggtgttgaggtgttttaatttcgagtaaggttgggtttttggaatttttttttcggtaggaggatttgtagttgaggaatttttaagaaattttttggtagtaaataaagtatggggttggacggtggatttatgagtgtttttatatgaatgcggatatagatagaaaagacggtaaatatttgtgaataaaaggaatggtttttgcgtattgaatttttatttatcggtttttgtttggtataaagtttttaggaattttttaatagttttagttagaaacgtgtttttgtttggttatgtggaaaattttatatatattaagatatatgatgtttttggttttttttacgaatgttttatgttttttgggtttatgatttggaatttgtagatttttgttgtttttgttttagagttataaggattttggatgtaggaaatattttttatgtgtaagggttttttttttttttgttagggtttatcggtttttttttgtttataggtgttatttaaatttttgtatttgtggttttttttttttaattatttcgtgtaattcgttaatagtttttttatttttagagtttggttgttggagatatataaggtatatagaattcgtgaaatgatattgagtatttattaggtatttattgtgtgtttcgtttggtaataataagtaaaattataatgttttgggtatatgagtatatttttttatgtttatttttttagtaatttaatgagatggttttataaatggggaaattgaggatagggaggttagattggtttaaagttataggttaggaggggtagggttaaaatttaaatttagatagtttggtattaaattttagttttttatacgaaaggtattttgtaatttttcgagaaggttgggattattatttttattgtatagatgaggaaattaagatgttaaatggttagatagttttggagttaggaggtgggtttagtggtttatgggagtatatggaatggagtttatgggaggttcgaggttgggatttcgtattttattttggtttaagggatgaggtgattgggagtgttagagatattttgggattggttatttaggtgttttgtatttagttttagcgttgagtgggcgagggtggataatttgttatttagtagggttgttgttcgtatttcggtggttttttaaagtttggttaagtaaagtaagattgttttcggattagagtgatttttaagttatataagtatttagttatgtttcggaggatgtaggattgggaaggttttttttttatcgtatttttatttagtttttttatggggtagttggttttaggtatagattagacgtttttttttttgtttgttgtcggtatgtttttggttttattgttgttttagggaggggtttaagagtttttcggtttcgttatttattatatttcgtttagagggtcgggggtttagtattaacgttaagtatttagtagtaaaattacgggttggaaagagttatagtgttgttttgatttggttttattttatatcgggtgtcgtttttattagtttttttttgtttttggttttattttttaggtattataagttttgtaggtttaaagttaaatttattagtttttgattttttttagttgggattagggtgaggttttcgtttaggtgtaaaagttaaggtagtgttaaaaaatttaggaattaaataatattttgaagtaatattttaaataaattaaattttacgttgaataaattttgatagggttgtgtacgtgtagggttgggtttgttttaatttaaaattttaatatttgtttattatagagattattatgtattatttcgatattgaaaaatattgtattaaatattatttgtgttgatttttgagttttttggtgtttttttatattttgtttttgataagtgtttgatatattttgttttagtcggttttgttttttaggtgtttttttggggttgttttgtttacgtttttcgtagttattaggagttattgagttattgtatttgttttattttgttttttatgttttcgtatcgtttatttcgttatgtttttttcgtgtgttttggtcgtacgttagttttagataggagttcggtgggttgggagtttatattaatgttgttttttttcggtttcggtgtcgggtatagggtagtattggagatttttttttttttttttttttttttttttttgagatatagttttattttgttatttaggttggagtgtagtggcgtaattttggtttattgtaatttttattttttaggtttaagttttgttttttggaattaagtagatttttttgttttagtttatcgagtagttgggattataggtatacgttattatatttagttaatttttatatttttagtagagacggggttttgttatgttggttaggttggtttcgaatttttgattttaggtgatttgtttgttttaattttttaaagtgttgggattataggtgtgaggtattacgtttggtcgagattttttgaataaataaatattatcggtatggagattcgtttagggaatttgtttagattttgttattgtatttttgtttgttgcgtttagaggtaatttagggtcgttttagtcgtttttatttggttattttttggtttttatttaggtcggtttgttttattttgtgggttaagaaaacgatttagtgggtggtgattagtattttttttttaatttgaaaagaatatatttattagcggtggtagtaatttaatgttttttagttgatgaaggtaatatgtttgtttataatggaatggtttatgttatggtggaatattatttagggacgtattggtatttgttataatgtggatggattttggaaatatgatattaagtggagaagttagatataaaggttaaacgtgtaattttttgtataagaaatgtttagaatcggttaggcgtagtagtttacgtttgtaattttagaattttgggaggttaaggtaggaggattatttgagtttaggagtttaagattagtttgggtaatatggtgaaattttatttttataaaaaatataaaaattagtcgggtatggtggtataggtttgtagttttagttattcgggaggttatggtgggaggatggtttgagtttgggaggtggaggttgtagtgagtagagattgagttattgtattttagtttgggtgatagagtgagattttattttaaaaaaaaaaaaaaaaaaaaaaagaatttatatagataggaaggaaatatggaggaggagggtaggattgatagttaaaggttacggggtttttttttaagaaaaaaattttttaaattttttaaatttttaattttttaaaattggttgtggtgacgatggttgtattattttttgaatagattgaaaattatggaattatgtattttaaatgggtggattgggttacgcggtgatttatgtttgtaattttagtattttgggaggttgaggcgggtggattatttgaggttaggagttcgagattagttttaatatggagaaatttcgtttttattaaaaatataaaattagtcgggcgtagtggtatatgtttgtaattttagttattcgggaggttgaggtaggagaattggttgaatttaggaggcggaggttgtagttagtcgagatggcgttattgtattttagtttaggcgataagagtgaaatttcgttttaaaaaaataaataaataaataaattggtggattgtatagtagtttatttggattttaataaagttgtttaaaaaaaaatgaaaaaaagttttttttttttttaaaataaataaataaaaagaaaaaaagagagaggggaaaaaaaaaaaaaaaaagaaaatattgagtgtagtatacgtatggtaaaggtaagaattttattacggaaatttggttttattaatatattttatttttatttttattttatatataggtgtgttttggttcgtggtgttaatcgtatgtttttttggaggttgtagtttagattggttttgaaagttgttttttgggtaattttaaattttttataatttttgaagtttttggtttgttgggattatttagttttttagatttagtttcgttattatttatttaagattgtagttttggggaggggggtttttttttaagggtgtaggggttttgtggttttatttttttttagaatatatattattttgtattgtatatatgtgttttaatatggagtattttaggacgttggttatagttagttatgtttgtatatcgattgatcgatcgtgttttgttgattaattatgttaattatcgcgttgtatattgtttttattaagcgagttaaagtaattttttcggaataagttgacggattttaaataagttaaaagatatttttttaggaaaaaaatagtaatgaattttaagaagaaagaaaaatttttaaatttatagatttatggaaaaagtttaagtttttaaagtgttagatttttttaaaagtattaggtttagatggttttacgagtgaatttttgaaaagttttaatagagagattattatgttgttgtttaaaatgttttagaaggtagagggtaaaagaaatgtatttaaattgtttttgttaagttagtataatgtagatattaaaattgataaaaatagtatatatatatatatatatatatatatatatatacgttttattcgttttagattaagttcgttgttgtgtatttaagtaatattatttatttttatttcgttgttgaaattaaaatatattttaatggatttatgattttaatatgtaaaaatgaaattatagaagtattagaagaaaacgtgggtgaaatttttttttataattttagaacgtaggagatttttaaataggatgtgaattttaaaagttaaaagggaaagtagagatttgataatattaggattaaaatgttttgtgtagaagaatattttagaaataaaattaaaagtaggtagttggggataagatattcgtatttgttgtgataaagatgtataaataatttttttttttttttagataggattttattttgttatttaggttggagtgtagtggtatgattatagtttatagtagttttaaatttttagatttaaatgatttttttatattagtttttcgagtagtcgggattataggcgtattattttatttagttaatttttgtagagatgcggttttgttatgttgtttaggttggtttcgaatttttaagtttaagtaattcgtttattttagttttttaaagtgttgggattataggtgttagttattacgtttggtttataaagaattttttttaaaaaattttaataagaaaaggatatattttttaaatgaaaagagaatatagggttttggtttataatatacgaagagataatttttttcgtttgatcgagatgtataaaataaaatattaattggagagtatttggtttttagttaggggtaaggggtataggatttttttgttggattattattgtatagggtttagtagatagttgagtaggtcgacgaggggaggggttttaaaaaattttagtaattattttagaggttaatttaggaataaggattaattttttttttttttttttttttttgatagggagtttcgttttgttatttaggttggagtgtaatggtacgattttggtttattgtaatttttgtttgttgggtttaagtaagttttttgttttagttttttgagtaattgggattataggtataagttattatgtttagttaatttttgtatttttagtagagatggggttttattatgttggttaggttggttttgaatttttgattttaagtgattagttcgttttggttttttaaagtgttgggattataggtgtgagttattgtgtttagtagattaaaatttaaatgtatatatttttgatatagaaatttattaagagtttattttttagttatgtgtgtatatgtataagtgcgagaatatttgttgtagttttttaattatagtgggaagttggataagtttggtagggttatgggatagttgatgatataattattaaaaggaacgtgttattttgggaggtcgaggtgggcggattttaaggttaggagtttaagagtagtttggttaatatggtgaaatttcgtttttattaaaaatataaaaattagttaggtgtggtggtaagtatttgtgattttagttatttgggaggttgaggtaggagaatcgtttgaaagcggaaggcgaaaggtggaggttatagtgagttatagtgagttgagatcgtattattgtattttagtttgggttacgttttgttaaaaaaaaaaaaaaagaaaaagaaaaaggaacgtgttatatttataagtggtaatagtgttgttaaatggaaaaaataaaagttggtagtagaagtttgattttttttgtgtttttgaaaagtttatatttatatattgattttttttatataagttttgaatgattttgtaggaataaaatttaggagaatgttatatttagttgttaatatggttattttttgggagagagttggggaatgggagagaaaaatttttttttaaattttatgtgatttttattttttatttaagaatgattgggtatcgttttttttttttttttttagatgggagttttgttttgttgtttaggttggattgtattggtataattttagtttattgtaattttcgttttttgggtttaagtgatttttttgttttagttttttaagtagttgggattataggtgttcgttattacgtttcgtcgtgtattgttttttaggatgaagaaagggaaaggttatagggagaatgggagttagaatatagagtagggtttttaaatattagtttgcgggtgagagagatacggggcgatattatcggtttggaatttagggatggtatgaggtgttgtttaggggttttagataaggtttgtttgttgattaagtaagggttgtgttggtttttgtttatgtgtttgtttaatacgaattttttaggcgttttattttgttttacgaattattattgtttattttaattacgttgtataggaagaattgtgtttatttttataatgagaaaacggattagagaggaaagttattaggtagggtaggggcggtagtttaggtagtgtgagggtaaagtcggtgtttttttgttatttttttatatacgagtgggtaaggtattataggagtttatattttaatttttgcgggttattttggaaggcggtagatggaattagtgatttttagggttatttttagttttaggttttagataggggtcgtggagtggaatcgagtttgatttaggtgtgttgatggtagttatgtaattgtggataaattatttttttttttatttgtattggatgagatcgggaatttttattttgggttttttaagagttttggggttttatagagtatatttagtagtagtagtgggatggggggatagggttaggggagttttatgttttttttaattttaattagagtatttttattttaatttttttttgggtttagtgtttagagagaacgggaaggaagtttagttttggttatgggttattttagtttgttagttatagtttatattttaggagttttttttggattgaaggagatagagttatttataatatttatagaaaatttcggagaggaagtggagtttaattgaggaagcgtttttttgtagtttttagaaatgaggttataggtgagatagtgtgttagggtggattatatggtatttttttaggttgtttgttggaatttagggtttggttaggggttgtttatattttgggtttcgaggcggggagtttgagtgcgtttttttagggttgaatgtgttttttgtttatatcgtatagagtatggttgtttggtcgcggcgcgttttttcggataggttcgttattgtgtagatttttaatttcggtagttgtttcgggtttgggaggcggcgggtatagatatagttttttttttttttggtagttgttttgattttttgggataagtgttgagaggcggttttatttagtgttatgtgtttgggggtcggggttttattttggggttaggttgggtggttagggttatagagttgtagggggcggagtagagaaatcgtttttagcgtttgttttttggttttattttttttcgtagttgcgttttatttaaggtattttatagttgttcggtattcgttgtattttcggattagtttttttttttttttattattgtacggtgtttggtaggtcggcgaggggaggggttttttttttgggttttggagttaggttttgttttttggttttatttcgttttattacgaaggagatatatcgggtttggttaattttttcgtattgatttttgtttttttagtatatgcgggattttttattttagatttaggtttgagaggttttagggatagttcggagaaggagggtatttgtttttagaaggggaaagagaaagagatttaattttaaagtaaaaggggatttgggtgttttttgtaagtagtttaggaaaatgggaggaggtgggagtagcgggatttttcgagtaaggtatttcggtaggaacgttagtgttttttggatatttttagaagtagaagtatatagttttatagaaaaattttgtaggtttaggattcgaggtatgatacgatttaaatttattgttttattagatattagtgagtttttcgacgtttattaaggttttttgttttatatttggtattggacgaatttgtatattttgttttagggagtttatagtttagggataggtttagagtttatgtggggtgttttgtaaatacggggttagaagttgggttgtttatggggttttttttttttaaattatagtggttattttttttttaattttatagtttttgatttttattaggaatttttggggtttagtaggtgttttttttttgtaggttgatgttcgttttttttattttttatttaggtttagttttgattttattttttttaaagttatttttttattgttttgtgttgggtggttttagggagttttgtgttttgattaattttatatttaacgttgtattggtagttttgttgtttgtgttgagatttttttttgttttgtttttggaatatacggttcggtgcggattaagtatgcgaagagttacgtttattattattagttcgggggggtttgattttttgtttttttaacgttttatttatatgataaagatttttagattttttgggttataggaaaattattgagatatgttgttatgtttatttcgttttaattttatatttatgtttataagtggttttagaattattgtggattttttttttggtttttggggtgggtggatatatgagagtttagtttttagttatttttgtagatgtttttttgatagattaagaaattgaggttgggaggggtggaatgatagtttagaattagttgatttatggggtagagttgggatatgtttagaattgagttgggtattgggtttggttttttttttgtttttagtgagtattttaagaaggtagagaattagatttatgaacgagcgttgagtattcgttttataaggtagttttggagaaatttggttggtgtggttgaggagtcggaggggggtaattttggtggggggggttttgagttagtagttagtttttgtaggtttagtattgggtgttgtagtttagttttattttattttatttagaggtatttatgttggggggtaggaaaagagtagggatttaggagaggaggtaaggtcgtttttatttagagtttgagaggattagggatgattttaaaggatgagcgtttttttgtgggaggatagtaaggagggtgttaagtttaggggtagggttagagtttcggaaatcgagaatttattttattagtataaagtttagattttattaggttttggggcggaggagtaggtagggatgtttttgttttttgtagcgttttttttttttttttttttttttaattatttaggtgtttatatttttttttgaaatgttgattttttttagaatttttatattgaagttaatatttatttattgagttttttagtataatttttagaggagagattaggtgttttgggggtaaagttgattaggaaagtttttgtttggtttttagggacgatttatgggggttattatatttgtttataagaattataaaaaagttattttaatttattattagtggtttatttttttagtataattttatggtatatttattatgtttaagttatttatttggtattttatgggattttttttttttttttttttttttttgagatagggttttattttgttttttaggttggagtgtagtggtataattttagtttatcgtagttttaattttttatgtttaggtggtttttttattttaatttttttagtagttgggattataagcgtatgttattatgtttggttaattttttgtattttttgtaaagatagggtttttttatgttgtttaggttagttttaaatttttgggtttaagtaatttgtttgtttcggtttttaaagtgttggatttataggtatgagttattgtatttggttttttatgggattttttataaaaattaagataggttgggtacggtggtatgattttagtattttgggaggttagggaagttgaggtgggtgggttacgaggttaggagttcgagattagtttggtttatatggtgaaatttcgtttttattaaaaatataaaagttagttaggcgtggtagtttacgtttatagttttagttattcgggaggttgaggtagaagaatcgtttgaatttgggaggtagaggttgtagtaagttgagattatgttattgtattttagtttgggtgatagagagagattttattttaaaaaataaaaaataaaaaaaaaatataaaaaaaaataaagataatagttttatttttagaatttagtgggggtatgaaaggaattttgaagattatatagtaaaattttaagtatggatatcgttggtttataggtgaattttaggtttttttttatttttgtattttttgtattttaaagaaagggtattcgattattttttatgatttgaaaaattatttttatatttaaaaaaaaaagtttagtagaggaaagaaagtttatatataaattatttatattttaagttaaatacgaggtatttggattaggttttgagggatgtataggagtttattaaggtagtgatgtaaagagaagtagaggttagggtttaggaggttagggtaaaggggttgtgaggaaaggtgtgagagattaagggaagattaaagtaggagaagttgggaaggagagaggtgtgagttgagtaggagagtgaattaatcgtggaggggtttatggtgagtgagtagagaaggtttagtacgggaagagattttagtagtgttgtgttttggggaagttagtttgggagtaatttagttggggttttaggagattttgttttgtatttatagttttggggtggagataaattatagtatagatgttttttcgtaggtagaagttaaggggttgggcgtttgtttagagggtacggaattttttttatgatttttttttttatggtgttagttggatttttggtgttcgggggatagaggggtcgtagagattggttagagttgtgtatgtcggggtttagggaatttttagtttagttttatatggaggggtagaaggggatgggtttgaaggaaagatgggtaggaagttgagttggagagaattggattcgtgtttagaacggtcgtgatatagagagggaggacggagaagtaagtaggtggtgtttcggaggaagaattagtggggtttaggtttgggtttttcgagaagttatttttatcggattttaagagtatttttttattgggaaggttttgttttcgtttgtttttgtattttttttatttggatttgtttaggtttttaggattgttagtttagtttacggatttttttacgtgagttggatttttatttgtataggtttttgttcgtgggtggtcgggtttgggatgttgatggtttttttttatgtttcggttttaacgtgtatattttattttatggagaaagttatcgtttttttagagcgttaggtttttggtagttttgaacgttgttgtttttacgtggtttgttttttttttttttttttggtttgatgaaattgtatttttattgttggggaagttttttggatattttttgtgttttagttattttgtttacggttcggtgagttttagaaagtagagttcgtaggttgtgtttttgggtttggttttcggtatagtttttggtataatttaggggttaaattgtgtttgtttttggaggagaatgtttttgtatatttttatggatatttttttatttgttttttagagttaggattacgtttttgtgtatttagtattagttattatcgagatttagatggttcggtgataatcgtttttttagttatattttgtttgatttagttgagtgtgaatatattaatttaggatgggggtgtattcggtacgttaaataaaggttttgtattaatagaaggtaggggaggaaatagttttttgttattttgtaaattgtttatgtttttggtttgatattatgttattagtaattattgttattgagtttgggtggttggggtagggtggttttttagagttaagtttagagagatgggagagggaatacgggattcgtatattgagggtcggaaaggattttttaaggtttattagtttttggttatttagtgtgtttcgatgttttttttgtaggaaatgtagagttttaggttttagattcgttaagataaatgtgtattttatatgtttatgaaagtatgaggagtattggtttttttttaaatttatattttttttaggttttatatttttttagtttttaagtttattgattattggagaatttttatttaaaaagaaaaattaaaaaggggttgggtggtttatgtttataattttaatattttgggaggtcgaggtaggaggtttatttgaatttaggagtttgagattagtttgggtaatttagtgagaatttgtttttataaaaaaaatttaaaaattagttaggtatggtggcgcgtaatttgtggttttaggtatttgggaggttgaggttggggaattatttgagtttagggggtagaggttgtagtaagtagtgattatattattgtacgttagtttggaggatagagtaagattttgttttaaaaaagttaaagaaaagttaaagaagatggaaagagggatttagagagatgtggaagtaatttaagggtttatcgatggaggaatagttatataatataagtgtatcgtataatagaatattatttagtttttgaaaggaaggaaattttgttttatgttatagtacgacggatgaatttttaggacgttatgttgagtgaaatgagttagatataaaatgggtagttattgtatttttttatatatataaggtttttagagtggttaaataaatttataataaagatagaaaatagaatggtggttgttagtagttgggggaggggtatggggagtttggtttaacggggacggagtttagtttgggaggatgaaaagggtatcggagatggatagcggtggtagttgcgtaatatcgtgaatgtattgaatgtcgttgaaacgtatattgtaaagtggttaaaattgtatattgtatgttgtgtattttattacggttagaaataagaagtagtagttaaattaaaaatttagattgtgttgtttgtttaatttaaagaaggtttattgagtattattgagttttgattttgtgtttagaattagatttggtttttgaggggtttttaatttagttggtattttattatagttttatggagttacgatttttgttggggttagggggtacgtttttgagaagggatttaattatgttttatagtttggtatttttaaataggttttgtgttttataggattggtattaattttttgtttgtaagttttatgttagtacggttgtgggtttgagtttttttaggacgttgttggagttttatggttttttttttttcgttagaagggtatttttaaataaaatcgtgtgtagttattatatagttttttggtttaggtatttttttttagtgttttgagaattttgttttgtaggttaaggtgttttttatgtttttttttttttgttataattattttttttgggggaggaggattagattatgggttttaatgtaagttttaggaggtatacgtttttttttttttttttaagttttcggtttttgttgggtatatttaggtagtttgtaattttttaagtaggagttattagaatgtgatagtttttttaggggttttaattttattttgttttatatttttgtatgagtttgttttggtttttgcgtggttttttattttttaagttttttaggttttttagggatatatagtagatagaggttttagtaaggtttacggtgatttataaaggaggttttttgaaatttagaaaatttttttaaatttttatttaagtttcgtttggggtattttggtatgtttttattagatagagagagttattttttttgagtttgtagatttttatttttatgtatttcggtttttttgggtttttagggtagtattttttattttatatttagtttttttttttaagattttgtggtaaagttagtaattaggttttttattattatagtatttaagatttagcgttttgcgatttatttttttggtttcggggtgtagttttagttatagggggttggggtttgggttttagtttgttttgtagttgagatataggggtaggttttgaattttttaaggtttgggttgggttgggggcggtgggcgttttagtaggtttgggtatttggatttttatttttttgggggttgcgtcggtggtaggggtagtgggtatttcggggattttggaggtagggggttttatttttcggtgggttgatttttggggtttgacgatggtgattttcgtttttcgaggggtcggttttggcgttttgtggtttaatatttcggtttttttgagttcgaatcgggacgggtcgatggtttcggcgttttttatttgtttggacgagatgttaatggatagtttagtgcgtcgggatatcggttcggtcgttttggggttcgagagttttatttttcgtagggacgttttgggggagcgttggtttagggagtttatatggcgggtcgagggttttgagttttttacgtttaggttttggaatttttgggtggagttggttatagtggttcggagtaggggagtttggatttttcggggtggggtggagttgggtgtttcgattttttcgattttaaaagatttttttaaggttgaaaaataaagagaggggatgtaattggtgaatggatggttagggaatatttcggtatgttttttgttaaggagtagtagaggaaggtaggcgatgcggcggtgagggtcgggggttttttttcgttttttatgttttagtaagcggaagggatagttttattttaggagaattattatgagttttggggtagagatgtaggttggagtgggaagatgttgttcgtcgtgttttgttatggttacggcgtaaattatatagtttttttttttagttacgtttatataggaacgttttagttttagagaagatttttatttttttttttttttttttgagatggagttttgttttgttgttttggttggagtgtagcggtatttttcgggtttaagcgatttttttattttagtttttttagtagttgggattataggtacgggttattatgtttggttaatttttgtatttttagtagagatggggttttattatgttggttagtttggtttcggatttttgattttaagcgatttattcgtttcggttttttaaagtgttgggattataggcgtgcgttatcgtgttcggttttgattttttttttgtcgcggttgtttttatttttttttatttttagttaaggtatatattgggatattattagtaaatatatttttattattagttatagcgggggatatgtttttaataataagtgatcgtaattgtaattaattagaatcgtagtaggaataaaattttattaatgatattaagggcggatattggagtttttagtgtcggcgaggcgtcgggtttatcgagtttattatatttgtagtcgtttaattttgggatgtaaagaatattagtatttttagtatagatggggaaagtggggtacggggtagatatagagttagattgtatattaggttgatattagagtttaaggttttaattatttggttgttcggtttttttagtttagtttataggaattaatttttttagttattagttttttttgtatttttttatttattattataagttcgtgtagtgatgttaattattagttttcgttttgtagttattttgtttttttattagggtttgttttttcggaggtagtggggatggtatttgggaagttgttatttttatagtttttataatcgtattttaaatgagagttagtcgtttttggttattagggttagagtagggagggatttatatggtaggtatatttattagttttttttttaggttagatttatagcgtatttttgtggagatttatagtgtttttttagtcgttttttgttttattaggttatagagttcgggttttatgggattttattattgttttttttgtttataggaaaagggatgatagttggtttttagtttttaataatagcgttttaggattaattttagtgttttttttttattcgtttttttttttttaaatgtatttaggtattggggaggggaagaggaagtttaattttttaattttggtcgttttagttgttagttttttgggtaaggtatttttgtgggcgttttttttaagttataggtattttttttttttggtggatatagacgaaattttgggttattaagtttaatttttattagaagttgggtaaggagtcgtgtggattttagagaatttttagttgttataggttttgttttagtttcgttattgttttagaggatatgggttcggcgtggttagagttgtttattttttaagagagtagaaatttggatttttatatgatattttttgatttttaaatgttggtataaagtaaaataagttttttttaaaatattgagtagtttggttgatgtggtgaaattttatttttattaaaaataaaaaattagttgggtatggtgatattcgtttatagttttagttatttaggaggttgaggtaggagaatcgtttgaattcgggaggtagaggttgtagagttgagatcgtgttattgtatttagtttgattgatagagcgagattttgtttttataaattaaaattaaaaataaaataaaatatcgtagggttaaataaaattaaatttataggttgtattcgtttatgggtttagttatgatttttagttgattacgtggtcgtagggtagtaggatattgagttttagagttaggggtgtgttaggtgtgggttttcgatatggtgtttttttgtttttttgtattttgtatgtaaattgttggttgtgttttgattttgtagaagttttagggttttaaggaaaggttgaatgtttatttttattagttagaaagtttagggtttaatgtttagaattgaatgtaatgagatgggtttattaagtttattatatttatattcgtttaaatttgggttgtaaagaatattattatcgttttcgtatagatggggaaagtgaagtacggggtagatatagagttagattgtatatcgggttgatgttagaaagtgtagagtttaatgtttgggttttcgtgcggtttttagggtttttcgcggttttttgatttgttttttgttttttgagtattgtttaaattgtttttatatggtgtgtttttgttttatgggtgttgtagagtaggggtcggtttttaggtgtttttagtattttttcgtgcggttaagttggagaatagaaattagataggagaaggttttgttttaggtttaatttaagaaaataaatgattttttttgggagattcggtgaattttttttttgggagtttttttggagttatttttattatggttaatttatgatcgaagatattgtattaaagtagaggttgttttggtgtgagtttacgattgagtttacggtgcggatgtaatgatttattttagttaggtttacgtgtataagcggattattttagaatcggagttggttttttttttagggtattttttttttttttagttgtttgcgtggttggcgttttattattttggttatttgcgtaaaatgtatatgtgtgtcggtttttaattattttttttttttttttaatgtttggtgtttttttatggatgggtttttttttttttattagttggtttttgtgtttattgtttggttttatgatttttttgggtgtttcggtttagtattatttttatgtttattagtttttagtaagttttgagatagtaggggttgttttattcgtaggggttattttattattaggacggcgttgtttaaaggcgagtttgttttagataatagttaggagattttatagtttttagaattgtaagagaatataattgtgtgttagaagaatagtgagaataggaggcgttttatttcggaggtgtttattttttttaggagatgttttattttgggggtgtttattttttttaaggaaattatgtttcggttggaatgttaagaaggtgatatttaaatgaagaggtgtttattttggtttacgttatttttttaaacgagtatgttatcgtttttttttttttttgggaattttttttaaagttaagtttattttagtttttttttcggggagttggttttttatatagtttatattattttttttttatgttattttggttacgttatgattgttgagattggttacgaggggtgtgtttcggtttttcgggaatagagttgaatgttttttattttatgatattatgtttttattaggttttaggcgtttttagaaaatttattaagttaggcgtggtggtttacgtttgtaattttaatattttgggaagttaaggtggatagatcgtttgagtttaggagtttaagataaatttgggtaatatggtaaagtttcgattttattaaataatataaaaattggttaggggtggtggtatatgtttgtaattttagttattcgagaggttgaggtgagaggattatttgaggttaggagattaaggttgtagtgagttatgattatattattatattttagtttggatgatagagtgagattttgttttaaaaaaaaaaaataattaaaatttattaaatgttaggcgtggtggtttatgtttgtaattttagtattttgggaggttaaggtaggtttaaggtaggcggattatttgaggttaggagttcgaaattagtttggttaatatggtaaaattttgtttttattaaaaatataaaaaattagttaggtatgggggtgggcgtttgtaattttagttatttggaaggttgaggtagaagaattatttaaattcgggaggtagaggttgtagtgagtttagatcgtgttatagtattttagtttgggcgataaagtaagattttattttaaaaaaaaggttggattataggattataggataggtataagttttgagggagtttttaaggaggagggacgtattagatttttatttttattttagtttgtgaagatttattttcgtttgaggttttgtagagggttgattagtgatttttaaaaagatatgtttaatatttaattttaagaatttacgaatgtgattttatttggaaaaagggtttttgtagatgtgattagggatttcgggatgagattattttggatttgggatgggttttaaatttagtgttcggtgtttttataggagaaaggtagaaggggatttgggatataaagagatacggtggggagggttacgtgatgagagtagagattgtagatgttgttagagttaaggagcgtttgggttaacgtaagttggaggaggtaaggaagggtttttttttcgagttgtcggagggagtgtggttttgttaatattttgatgttaaatttgtggtttttagaattatgagcgaattaatttttgttgggttatttggtttttagtaatttgttttagtagttttaggatatttataacgagatttttgggaagatgaaatttttggttgtatagtggtttagggtgaggttagttggtgtggttatttattttttagtttagttttaattttattataattatattcgataaatggtttattgtgggttaacggatacgtggttattttagagttgttatattaggagtttagaggagcgagagttgtttttttttttttttttggagtcgtataaaaattttagatggttggagaagttatcggaggaattatattattttagatttttgttttattgttgggatatgtggtaatgaaataagattatttttgttagggatgttttatgggtaattgtttttttacggaggatattgtgagttgtatttagtcgggaaatattaggagatgtttgttattaggttggtagaatagggttttttagtatttttttttttattagagttttaagattgcgttttgggttttgtagttatatacggtcgtttttttttttttaatgtgtaggttttttgggaagttttttgttattatttttatagtggaatcggtataatttgtttaggggtagtaggtttttgttattttatacgtttttattttttttgtggagggagacgtagttaaggggtatttatatttatttatagaagcgagagtgttcgtgagtttgttattttgtagattttagaatttcgtacgtgattgtatagatttataggtttaattgggtagatttaaaggatttacgtagtagggaggagtatcggatagtttttttttttgtttgtaaggagttaatgtaattgaaggatatagaagaggtttttagttgagtattataattgtggatcgtgtatagtgttagaaagatgcggagttaggttatgttgggaggatttttatgttgttattggaaggtaaagtagtgttatttttttatttatagagtaggaggtttttatttttgttagttattttttttatttgtgaatttaagttttttaaagttagattttaatttcgtaagtttttaaaagtttttttgggttttttttttaatttttatcgattttaatttgttttaaaagtttgaagatcgtttatgtgttttggtttatttttgggaatttattttaaggaaataattagaagtatagaaagatttacgtacgaggatatttgtattagtattaaattgataaaatttggaaatagttcgggttttcgtagattttttaaatttatatgttaaaggtttgtattattattaaaattatatttttgaagatgagaaatgtcgagaatattaagtaaaaatagtaggatataagatgtatataaagattttaattttattttatatatatatgtgtagtttgtacgtatatatatatttatattcgggtagaaaataacgatttttggatggaatgaatggcggtgggtgttgtttattatatttttttgttttttgagatgtttatattatatggggattatttagtatgtttagggaataaaattatcgatattgtttttttttttttttttttttgagatagtttcgttttgtcgtttagattggagtgtagtggcgtaatttcggtttatcgtaagttttattttttaggtttacgttatttttttgttttagtttttcgagtagttgggattataggtgttcggttattacgtttggttaatttttttgtatttttagtagagatacgattttatcgtgttagttaggatggttttaatttgttgattttatgattcgtttgtttcggttttttaaagtgttgcgattataggcgtgagttattgtattcggttaatattgtttttaaaaaatatattttggtattggttgggtatggtggtttatatttataattttagtattttgggaatttgaggttagaggatcgtttgagttaggagttcgagattagtttgggtaaatggtaagattttatgttggaaaaataaaattaaaaaaaaaaaaatatatatatatatagattttgatgttaataagttggagggtgtgggtaattgtatgttggtttatttttatttttatttttggaaaaatattttatagtttaggatgggtatagggttttttttatttttaagtatttacggttttagttgttatataaaaagaggttatagtgggttattttttagatgtaaatttttttttttaggtttatggcggggtcgaaataggagtagtttggatttgggtttatttagagaggaatgtgtcgtataagggattattgttaaggtttttgttttgattataggttgtttggtaaatcgtttttagtttttgaaattagattaagtattttttggtgtatatattaggttttagtttggggagggaatattaagcgagttatagagttttgttttagtttgggataaatgttatgtaaagaaatggtagagtttaaggttagaataattttatgcgtagtttagttttcgtaggagggagtaacgtggtttttgtttagggtagggtggaattttaggtttaggttttaggaacgttagttttggttaaattgggttttttttgagtagtagtaaagtaggttttgtttttgaagaaatattggttatttaggagttagggttagggtttagggaagtcggatagatggtgttaaggagtagggaagtatttttttgtatgttattttgagtttgtaggaaaaagttacgggaaaattttatttggtagataattttttataatttttaggatttatagagtgagtttagtagtatgtacgttatgggtatttttttgtttttatttttttgtgatattggattttggtataggtttttgatttgtgtagggtggggtgggtagttaggtagggttttggcgttggtagagtggggtttagttgtaaaggtttttttattttttatttatttaggatttgggggacgaggtttaaaggtttggtgtgtttttaaggagtttaaggattgttttagggttggagataggacgtatgggtttgtatagggatcgtgttttttattttagggttgagagtaggagaattaaataggagagtgatataattatagtttattttgagttttagtgtttttagtgttatttgttgtaggaggtgatggggtaataaggtgtttttgaggttaggcgcggtggtttatgtttgtaattttaatattttgggaggttgaggtgggtggattatttgaggttaggagttcgagattagtttgattaaaatggagaaattttatttttattaaaaatataaaaatagttaggcgtggtggtgtatgtttgtaattttagttattcgggaggttgaggtagaatagtttgaatttaggaggcggaggttgtggtgagtcgagattgtgttattgtattttattttgggtaataagagcgtaattttattttaaataaaaataaataaataaataaaaaataagattttttgggtgtaggtatggtacgcggtaggggtgattgttgttggtgtaattattattttttgggtgtgtgtttgtgggggttgtgtatgttgaaatgtgtggttattttgttggtgattaaggttgttttggttttattgttattaattacgtttattgattttatatggtttattttcgtgtttttatttagagttttttttagtgtttaagttttcggaaggttggaaggagtgagtagtgtagtttttggttaagaattgaagtataaaaattttagtttttttatttaattttaggtgggataaggttgggggtacggtttgtagtttttttatgttgttcggtatgggggttgggtagttatttgtggttataatgagttggtgaggtattttttattggttggattttttgtttggtttatttttatatttaggtattttttggtgtttttttttattgaaatttttgttttaggatttgtttttggagggatataaattagttttttagaattggtttgggttgtttggtggaggagggaggtggtttttggggtaggtggagtaggtttcggatagggaggaggatatagttggggtgatggggaggggtgtgtttttaggaagtaaaatcgtttaaaaggaaaggtttaaaaataggcgtagtgaagttgagcggagtttgtaaagggaagttaggaaatagtagtgttagtggagggcggtttttaggttttttatagagagttatatttgtttagggatagggataacgtgaatagaaggtaaagtttatattaaggcggaggaggcgttttttttttagagagtcgtagttagatagtttaaatttgttaaaggtttgggagggaagaattagggtattattttatttttagtttaattttttttttagttttttttttttttgtttttttaaggttaggtttggttgggttatagtgttagtagttaagattcgtttttagtgtcggtttagttcgtaggaggttagtttggtggttaaaggttattgattgtttaggtttatttgtatacgtggtttaatgattgaggtttgggatttggggttattatttatagtatttttggataaggaggaaaagaattatttttattaatttttggatggaggtgtagggagcgttaatagtatttttgaaaattttaaatgtattaggggggttagtatttagggaagagttataggaggttattttgatggattttgatgattatttttgtttaagtgttaggaggaggtttttttttttttgtttttggtaattttgggtttaagaagttttaggtatttcggaggttttttttgtttattatagttttatttaagaggtttggtttattttgtaatgatgatgtgagaatgagtaggtttgtttagtgttagagtttgtggttggattttcggttgaggttaagagaaataaataagttttttttttttttttgtacgttataggaagagtagttcgttggttgtaaggggattttttattttgtttatggggtatagtagtttatagtattttttttagaaacggagtattggtaggtttgggtttttgtaagatggaatataaaggggtgggtagttgattttaatagttagtttttgggattttaaatttttttttattttttaattttgtgatgttaatttttttttggataaagttttttaataatttggtaagttagtattagttgaattagttttagtttgaattagtagttttttttagtttagttatagttttatttttttagaagggaaaagaagttttacggatttttttataaggaatttttagaatttgttatggtgttcgtaggggatattggtattaattttgggtttattaaatgtagtgggtttaatagtgttttttaaaacgatatgttttaagttttaatttttggaatttgcgaatatgattatatttggaaaacggatttttgtagatgtaattaaggtaagggttttaaggtgagattattttgaatttagtgggttttaaatttaatggtgagtatttttataaaagatagaaaaggagaaagatatatagatagggggagaaagttacgtggagataggggttagagattagagatgatggtgatgcgtttgtaggttaaggaacgttaggaatttttaggagtcgtcggaagttatgtttgtaagtttttaggttgtggtattttgttatagtaattttaggatatagattttaggaatagaatatagaaaagaaacgggaggaggtttagagtttgttgtggttattttagttattttattcgatttttttagtgtttcgttaattttgaagttttttttagttattgagttatcggttttgaaaaggagatatgggtgttttggagttggtttagtttggtaggaggtagtttcgttttattgtttttttattagttattagtttatataggttttttatagtgggtaagtgcgttgttgttttagttttcgtcggttttttttttgttcggttttattagtcgtagagttttttgttgttgttttttttggtttaagaggtttatatatttagtttttttgggataaatttagtttatatttgttgttttatcgtagttatttaagggttttttttattaacgtgttttttaagggatagtaagttatacggtcgttttatttggggttagaattgtgttttattagagtaaggttttggagtaattatatttagggttagggagttatttgtttaagaatagaaacgtgtggtcgggcgcggcggtttacgtttgtaattttagtattttgggaggtagaggcgggtagattacgaggttaggagatcgagattattttggttaatatagtgaaatttcgtttttattaaaaatataaaaaattagtcgggcgtggtggcgggcgtttgtagttttagttattcgggaggttgaggtaggagaatggcgtgaattcgggaggcggagtttgtagcgagtcgagatcgcgttattgtattttagtttgggcgatagagcgagatttcgttttaaaaaaaaaaaaaaaaagcgaaatgtgtagttttttttttttttatttttgaaatatgaaggggaggtgattgtaggttttttgggaaagatttttttattttttttttttttttttttttttaagacggagttttgttttgtcgtttaggttgcggtgtagtggtgttatttttgtttattgtaagtttcgtttttcgggtttatgttatttttttgttttcgtttttcgagtagttgggattacgggcgtttgtttgggatagttacgtagtagtttttgttttaagttatttttttttacgtagagtagaattaggattatagtaaaggttttagaggaggttatcgtttatagggttttgggttttttttttgaaaggtagtttagtttttaagagggtaatagcgattgattcgggacgaaggtttttttgtgtttgttttcgttatttatcgcgtgtttttggtttcggtagttatagggttattttaggcggattttaaagtggcgttaagttgttggatttttttttttttttattaaattagttatgggaatgggagtatttttggtatatttttagatgtgttgtattggtttagcgttttttttattttcgggttttaaattagttgttggttgttttattaggagtagattgaggggaaatgggcggaagtcgtaggggaagagatgtgaggtagataaagaggaagaattttttggttggggtggggtcgttagggtttgggtgggagggtcgtttatttttcgtttttggtggaaggtagtagaagggtgggacggatttgtgtgggagggtttaggtgtggtttgtttgggggtaggagagggattagatgattttttaggtttttttgggttaaagattttttgataaatggttgtcgttgaaggtaggagcgaggttttgggaggtgattgatttcgaaaaattataggttgtagttttgagggttttaaaggttaagtacggagttttttaaaatgaggttttttttagttttaatttatttacgttttttaggtggttttagatatttcgttagggtttttttggtagtttttcgttttcgattttggagatagagaaacgtgatgttggtttttggtttgtttatagttttttcgtttttattatagggtcgttagttatttttttagtttatcgcgtgttttttttttttttttattttcgattttttaataatagtagatttttttttaaatatttttttgtttagatttcgggttttacgtatgttgtttttagaaatgtattttagttttttgcgaggagttagtaaggttgttcggtgtttttttttatggatgggaagttttgtcggggattaggattcggatttggagattttgaggagcgtgttggttagtgtttgttttgaggttcgggatagagttgttaggtataggtagtatcggtgtgagggtttagtttttcggataagtttttttttgtttgtttttagatttgttattgtatatataggcggtgattatttttgatttgtttgggtagagaagttattttttttttttttttcgttttattgtttattaggggaaatgttataagtatttaaaaaatgtaaaaaaaaaaaaaaaaaaaaaaaagcgtttaatattaggggttatttggtttaggtggagtttttattaattacggggttttttgtgttgtggttttaaggcgggtagtcgatggtttttgttcgagttaatatgagttgtagtttaattataggggacggtgattttagggagtagagtttaggtttcggttatagttgtatttaggagttagttgttttttagatttgtagagttaggggagaggtttggaggatcggtattgaatgatatgatttaaagcgcgttaagttgggttggaggtgacggtagagttatagtggttatagagtttttacgtgaatttatacggatttgtttggtttaggttttgttgaattttagggtgaggaggatttggtttttatttttaaagatatgaagaggttgataaagaagagttataggtaaaagggggtggtgggtgtgttgtgtaggaggggtcgtaattggacgtagaagattttagaaggggtaattagagagaggtagtatttttagaagacgggttgtttggttgttttaaatagtttagggtgtgattgaggggattttcggatttagtcggggttttttttgttttgagataacgtattgggaaattttattaagtttatttaagaatttgaaaagttttttggaaatttagcgggtagggcgggtttttgggaggatttttggtatatcgcgagagttagatatagcgagggggttttatatttttgtttagaagttttacggtagaggggtagaagtttagggaggagtaggcgttgagattagaggggtttataagagaggggtttggggtagggggtagttgttgagaagtttaggaaacggcgtttgtttttggggaagtgaagttttgggaatagggttggtgaaggggggcgggaagggggaggtgggggtggagggttaggttagattaggtattttttttagtagtagatttatgagtttttggaatttgtttatagaagtgataagtgttttgtttttagtttcgtttatatatttatttattaagtgtggtagggatagtcgttttttattatttattttgggatttggatttaagtggaggtttttggaggggtagatttaggggaaagggtttttttagaagtagtcgttatttagaggatttgagatgagaattttattacgtttttattagatagaggagattcgcggtgttttcgagtttggttttttattttttatttagtagcgtttttttcgtttattttaagtttagaatattttgttttttttaagattagttgtcgtagtggattgaatagtgatttttaaaagatatgttagagttttagttttcggatttgtgaatgtgataggagttggaatagggtttttgtagatgtaataaaggattttaagaggagagtattttggatttagggtgggttttaaatgtaatgataagtatttttacgagatatagagatatagagaaaaggttatgtgaagacggagtagggagtggcgtgacgtatttatatgtttaggagtattcgggagttattagaagttgggagagaggtttgggtcggagtttttcgtagaggttttaaaggattagtttggtcgatattttgattttggatttttggtttttagaattatttttagtttttaaagttcgtggggttttgttgtagtagttttagtaaattgttacgggggttttttttttttgttaagtttggtatttaaagttttttagttatttggggttaattatattgattttgggatttttaggttattcgtgtgttttatttttttgtttaatttttagtgtttgtgtggttatagtttttttttcgtgatatgagttttttgggtttttgagtgtttatttgttttgtattgaaggttgaagttaaattttggagagaattgattttttttgtgggtagggtaggtattgtgtttttagtatagttagagggtattggttgaaatgtgtttttgtaaagtgttttttttatgttcgtattttttttttaagtggggaagttagagaggttttttcgattttttttttagttttttggggtaggaagtttgtggttatttgttcgtaaggattaggtggatagataattagttttttttaggttatattttattaatagagggttttttaattttgttggtggtttatgagagaaggaaaaattgaaggagttgtttatagtaaattttaaatttttgtgttagagaggtttatggttgagtaaggtatttttatttttattgttttgagttgttaatttagtttagtttagtattgtgatttttgatttgtttgtgggttacgggagtttggtttgttaattagtattttttagatatttattttgtgaagtttttagtggttgagtgttttttcgtttttttcggatagcgtgggttataggggatattgggtaggaagatagttaagtttttattgtttagaaattgtttgggtttattgtagtaatagggatttatttattagtatgaggtttttttgtaggaggggtgggggtaggagggagtttgtggggtatagggttgtaggaggagttatttttttttttattaaatcgtaggttttagttaagttatttttagtatggttgtttgcgtgggaagtttatagttgagggattgtttgtacgtggtatgtaggagttataagcgttatttatattttatttcgggttaggtagatgatttttttggttttagttttttgatgaggaataggaagggttggatcgaaagattttttttagttcggatatggaatgattttacgagggttacggtgaggtttgttttagtttcgtatattagttcgggttagtagtttttaaaggtatagtcgtaggggttttggagtagggataaggaggattagtttattttatttttttgggtagaggttaaggattttgtttttggtttatattttttgtggttaaaaatgtagaagtaagtagtgttggtagaggtatttagatttttgggtaaagtaggggttttatttgatattttaggtttggagtacgagaaaattagtttaggttttaggttttttgattgttagcgattagggaatgtgatatttttcggtttttgtttttttattttttaattttagggggagattaggttgggtgatgtgtttttttttttgatagtaaatttttatttatttttatttttatttttgttttaagagggggttttttatggtcgggcgtagtggtttacgtttgtaattttggaattttgggaggtcgagatggatggattatttgaggataggagtttgagattagtttggttaatatggtgaaattttgtttttattaaaaaatatgtgagttggtaattttaagtttttagtagttttcgaatggaggttttttttttgtaggatttttaaattttataaatatgagtgtttgtaatttagttatttaggaggttgaggtatgagaattatttgaatttgggaggtagaggttgtagtgaattaagaacgtgttatcgttattttagtttgggatatagtgaaattttgttaaaaaaaaaaaaaaaaaaaggtgggggtttttttatgttgtttaggttggttttaaatttttgggtttaaggaatttttttgttttagttttttagagtgttgggattacgggtacgagtttatgaattttaaaaaataatatttattgttttgtttttgattgtaaaaggaatttaggtataaagtcgaaaatttgtaaaatgtataaaaataaagggaaaaaatttataaatttataatttaggtaatttttattaatattttgataaatgtttttttattttttattggggagtgtgtgtgtgtgtgtgtgtgtgtgtgtgtgtgtgtgtgtgtgtgtttaaataggtttatatagtgatgatgttgggtgtttttttttatgtggcgttatgtggttgaggtttttatatattttgggttcgttttttcgatttttttgtagttttgatgttttgattttagatatgttatttttggttcggattgtttaggagaattatttttggattttgttaaaaaatggattgttggtttttaatttttggtggttttggtttaggagggttgggtaagtttgggtatttcggagtgtttttggggcgttgtaggtgtgaatttttgtttttttgaagatttataagttttattttttttattttttttttttttttcgagaattttataagaggaaagtttttattcggaggttgttagggattcggagttgttagtttatagttttattttgtttttattttttcgggagttatttaaggataatgtttagttttagttgttaagttttagttttagggttagttatatattgaaggatatgtagaagtcgtcgtgtgttgggtattgttgaggataaaggtttgaatgataagcgggaataaagttataaggttttaaaatttgttcgaggttttatagttagggtttcggaaatttatgaaaaaagttagtttaatattttgttacggaatataggtaggagagggagtagtttttagttagtttttagttagtttttcgttagtttttttgcgaattattttatttcgggttatagttagggtagtcgtcgtttttttttttgttcgatagtttttgagggtaggagttagtttgtttattattgttttttttttattagggtttggtattttgtttggtatgtagtagaagtttaagaagggtttattgtgtttattttgtaatagttaatgtgtatgagtgtttattatatttgaagatagtgatttatttttgtttttattgtatagatgggaaattgaggtattgagaggttgatgatttttttatattgtcgtgtgggtaagggtaaggttagatgtgagtcggtacgttgggttatcgcgttttttgtttatatttcgttttgggtttgggaaggttattttcggagatttttacgatgttgatatttcgtttagttttttcgtgtatttttttttacgttttttagttatttaaagtattagttaggtagtattgttattttggttttgtaaatttagttattgagtggaagagtagttaggttgaagtggggtagaggtagttttcgttagattttagggtcgggatttttagttatttttattttttaaggattagtagatagagatttttatcgtgtttagttaggggttagggaataggtttttatagtgggggagtgatggatggatgtaggtgcggattgggaggattcgggtcggttttttagcgttggagttttagtagtttaatttattttgttgggttttcgtggggattaaaagatattttgtatataaagtattagtttagggtttggtatttaggaggtgtttaattaaaggaaatggttatgaaaaataataaggagaagtttagttataggaggtgtttgtgggtaaggagagaatagttggaagggtttggatttgggttagagataaagaatgtaagagggagggagggagagaaggagggagggagagaaagagggagggaaagaaagagggagggagagagggagggtagggtaggtaatagttggttttagggtagttgtgtgtaggagtttgttttattatttaaatattaggagagatgtaaatatttgagtgaggtttttttagtttggttttgttgtggttatagttagggttggagaaagagttttttttttattagggttttcgttttgtgttttttattttagttgttttaagattttatgttttcgggttaggagtaggggtttgagagtagtaattaggtagggtagcggggttagggagggatttcgtttttgtttttatttttttttttcgtttttgtttttatttttttttttttgtatagtattgggtttgtaaaggtgcgaatgaaggatttttttttttattcgattttaaggggtttaggcggttaagggttttttttgtagtttagaaaaaaaagtaaagtagttttttttgaggttttttggtggaggtttagggtttaaagttcgttgttataaatttgtagttttttttgtttttttaatagtgttttttttttatttgggttattttattattttggttttttttagttttttaggttttttggggaggaggatagatgtagagtttggatttcgtgcgtagtagggtttttttaatgttgcggtgtatttcgtttggttgcgggagtttgttttatgttatgatttgtgttggtattaatagtttttttttttattttttatttgagtgtcgagggtagttgtgttaggtatagatatatagttttttatatatattatgagtttgtagaaatggtaagagaaggtcgagcgtagtggtttatatttgtaattttagtattttgggaagttaaggtgggcggattatttgaggtaaggagtttgagattagtttggttaataggatgaaattttgtttttattaaaaatataaaaaattagttgggcgtggtggtgcgtgtttggagttttagttatttaggaggttgaggtaggagaatcgtttgaatttaggaggcggaggatgtagtgagtcgagattacgttattgtattgtagtttgggtaataagagcgaaattttgttttaaaaaaaaagaaagaaagaaaaagaaaaaaagaaaaggaaaatggtaagagaagttggttagtattatttgtttggtaaatttttatttcggtttttggttaggaagtttttttttaggaagttttttcgttttatttttttttttgagtttatgtttagatttttagtgtttagaatagagttggtttttggggtatttatggatggttgttggataaataaataagttaattgttttttttatttttagcgatgtttttggtttggtagggtatttagtagtaatgtttttcgagtggattttaaggagtattttttatcgtgtagtttgtattagggattttagttttttattttaaattaaaggaaaaaatttaattttagtaaatatatagagtattttattttttgatttttaatggggggtaagaggtagaggatagaggagaagattatttttttaggtttggtttggagttaaaaagatttgtatgtttttattgtagataatatcggtttttgggggatatagggtaggggtttggtttgtttttcgtagggaaattgtttatttacgtggaaagcggggttaagggtttttgtttggaattagttttttgtatatggggtggggggtggggatagaaggagattttgtttggattgtatggaaatttattagattgttggttgttgatttggtaggagtagagttatttttattttttagggttttgtttgggggaggggagaggttaggtggttttgtttaggttatattttttatggttaggaatgttttttttttattagaaagaaagatgagataggtttattttgaattttttggatataggaagggggtttatttgtggtttaggtggtttttttttttatatttaaggggttttataaggaggtgttaggatttttaggttttgttttagggaattgttgtttgtaaaggttataggtagagatagttaggaatgttttttatgttattggttatgggttggaggttgcgaaattaggtatagaattagaaagatttgttataggttgtaaagggttttagagagttttagttttttagaggggtagtattgtagaaggggtgagaaggaaaaattagtttttaggaattgtttatttagagtttatataatatttaggtggtacgagataacggtttattttttattttattttttcgttgttttttaagatttgagtttttgggggtgtttttagtagatagggggatgtggggtaattgtttttttttaattgtatatttggaggtaatttatatttagatgattttttcgaggttgtgattagagtttggggtaggggaggggaagcgggtggatgggaaggcgagggagatttttttaggaaagtcgttttaggtgtttgtaaggttttatcgtttatatttaaggtataggtttttggttttgaggatataggaaattcgatgttatgtggggaggagggtattgtaatgtatttaaggttaggttttttgattttttggatattggataaatgatggtttttttagttggtttagagatgttaggagtgatagaatgttaaaggttgtagggggatatttagaaattttcgagaaagaagatggataaggaaaaataaaaaaatacgagaagtttagtagagtttgagtttcgtattttcggttttttttatggttacgggtaattttttggagatttagttacgggagtagtggaggtaggtatgggtgggggggggggcgggttttattgtttatggtttcggttgatatcgaggttatttttttgtttttttaagtttttgggtattggtaggatttttaaaaacgataataaatttgaagtttttagaattgtttgttggtttagtttaaacggagtttcggggttttgtagattaaattaaatagtttgagtttagaaatgttttaggcgtttgggggtgtttaggggttaattggtgggtttgtttggttggagagatgataaatttttttatttttgggattgtgttttagagagtttcggattttttggttttataagtaatttagagtttttaaatttgggaaaaattaagagggttttggaaagaaaggtagtgtttgattatttttttttagtggttttgttaagggagagtataggaatttggtttttggttgggtttttgggatgaattaaaataaaaagaaaaagtcgggggagggggtggcggaatcgttcggggttttagtttaggttatatattaaggagattttagaggagtaggttagttttattttcggtacgatgatggacgggtatttggttggttggtaaagggaagagatggtaatagtgaggttttgaatttagtggttaagatttatttttgagtgtgattttttttgatgtttgggtatgtaagaaatgggaggtggagaaaggaggaggagattttagttttgttttttcggtattaggttattagggaatagtattttttttttaacgggtaggtagaggttataggttgttaggttgagaagtttttggtttttatagataaatgtatagtttgtatatttgtattattttgggtgatgtttattacgtacggttattatgtacgttttttattattaagatagtcgacgagattaggtggttattgtgtatcgggtatcgtggtgattgtttgatattgatttttgggggtttaggttttcggtgggtttgtttttttaggtatttagttttttttttattttttgatatttcgggtttagtgtaggggtatgggggtgtttagtggatgggtttacgggttgggtaagtagtacgtagttttggtttattagtttttggttttattattagataagatgagattgttttagttgttagtttagttttgtattatatttgattgggtttttgtagaggtttgttggatgagaatgtttagggtagtaggtattattttttgggatgtatattttgttataatcgttttttagggaaaggttagtttgtagagtcgaacgtaggttgttagcgttttcgttgtttttatggttcggttatttagtaagtgtttattttattgttagcgtttggttttgtagatgggtatatggtttatttatttgtgatattttagggtgggggtgggggtagatggtggtagggaagattaggataattttttagtaagaggaatttgtagttaatatgacgttagtttttagaatgttagttaggtaggaaaaggggggttttatggttgtattgggagtttgagtatttgtcgggtttagagggatttttaggcgggcgttattggtattagtgtttgtcgtgttttttataattagtggtgattatgttgttcggttttatttatatagtggtattatataggtttttgtttgagattttttatttttagatttgtatatttaagtatttaaatttatttgttttttgtaaatgtttttttttttcgtttagatgttatattagtcgcgatatttattatattcgtaggaggtaggattcgtgtttagcgttatgggttgtattttagagttttttagtaatttttaaagagagttgtttttaattttattttgtaggtagggaaataggcgaagaaattgaagaaatcgaagtcgtttagttttttaatggtagagtgagggcggtttgggtatttttatattgttatattttttatttttttaaagtattgtttttttggatgtaaattttgtttattagttttatttaaaatttttttggatagttatagtttatagaaagtatttttagtttgtagttatttagttattgtaggggtgttttggcgtttatttttatttgttttttttcggatatttagtttagagaatttatagtttcgttgtaaggttgattatagtgtatttgttgtttgggtgttgtgttcgtttttttttaaatgaattaattcgtagtcgggatagtgggtttgtttggttttgggttttgaatttaaagagtattaagttagtgttgttagtggttgtgggattcgtgtaagaggtttgtttttattttttatggtttttgttttttattataaaagtttaaattgtagagaggtagtatttataggatgttttgagttttggttgaaaggtagggtttattacgtaagaggtttattggtattaattagggataggtttgtatttattattaagtaacggggtttttttttttagagaggaaagaggtatttgaattttgttagcgcgttagtttttacgtttcggaggtgttgggatttttagataagaaggtatatttatatggttttttttatttagaagttcgttttatagtttgttttgtttttagaatatagatttgggggtttttttcgggcgatagtgggggttcgggagaagtttagatgttatatagttttgggatttgagtacgtgggttttgggttagattgttttaataaatattaaggatttttggattttttttcggtgtgtaaatttggttatagtaaatatcgttgagtaaagtaggttaatagttggtatttggaaaggtttttgttatataaagattcgagttgtaatcgtgtttgcgataatagatttggtttgaatttacgaaagtatatgtcgttcgttagtttcgtgtttttattaattagaagggagaaagaggaaagggttattttttttgttattttattacgggtagtggcgggtgttgtagtcgtttggaggttcgtttgtatagtggaaaagtagaaaatgagattttaaaaattttattagttaaatataaaatattttttttgttgttacgtggcggtttttatagagttttaaaattttgaagttcggagatttattttgaagggggagtaaaggcgggatgcgggaagtttgagtttatggaagatattgatattttttttatttttgggaattttgagtttgaaggattcggtttgaatagcggaaggattgaatttttgtgtaatttatcggtgatggaatataaagttatggtgttttcggtttttaagacgggagggatggggaaggttttgggtgaaggggataggcggggaaggaaaaggtgaagagaaaggtgttttttagggagggggtagatgtgtttaggatatgggatattggtagaattttaatttcgagtatatatataggtttacggacggtttttcgtttatttgttttttacgggtgtgttgtgtcggtttgggtatttgtttttttttttatgttaggttatttgtcgtttattttgtatattgttattagttttaagttttttagaatattttgattagggttttgtggtttttgttataggattttaggtttagacgtttgttcgattggaaaattgtttttagagatgtcgtggtttagagttcgttttgttttggggtggtttttggagttttcgttttttagtaatttatatggtgataggtatttatattcgttggttttaggaattttggggttattattttagcgttgtaaggagttggtagttttttttttattttttcggtttattttgtaggaattaagatattaggtgagtcgtttcgggaaagagatttgtgtttttacggcgttgtttttgcgtttatttttagttattttagatgtttttcgtggattagttgtattttcggcgggtatgtttggtttttcgtagtttggtttatatgatttttataggtaggtttttttttatgttttagttttttttttagttagtttattttagttttttttattgttgttggttgttgttggttagaaggttttttttttttttgtaatttaatttttatttttttttaaggttcgttttttttatattgattttttttttgttagttagtggtgatttttttttattttgattcggaagttgtttgtttatattatttttggttgggttgaattatatttttttttttattttttttaattattttttttttacgtttgtttgtttatttaaggttgtttaatttttatatatatatttttatattttttaattatattttaggttttttgggtattagggagggttatttttttatattttaggttagtttttatgtatatgcgtatttatgtatatatatatttttttacgtttatcgattcgggttatttgatggttttaagattagaatttttagtaaaattatttaggatatataagggggagattgataaatatagggaattagtagattgaggttttatttttcgagattgagaaatttttttttagagttaaaggattgttaattgttgtattaggatggttttaatgagtttattgttttggattaaattatagggttataaaattggtttgggagatagtcgtagaagtagttttagatggaggtatatgggggtaagggtggagttatatttagagatttaaggaaggggtattaataatttttatagtgtaaatggtgatagttgtataacgaatataattttaaattttggttttttttttcgttatagggttttcgttgagatacgagagtttttttttagaaattttattgggggttcgatattttttgttaggaattgagagtagagatttcgatttcgtaggtaggaggagagttttgtataatatagggtttttttttataagggtttattggaaagtggttagatcggttaagtcgtgttatttggatatttgggataaggaaggtttttggaggagcggtcgtagggaggagttgtaaagaggtaggggtagggaggttatatttattcggggattgtaggaggtttaacggaatatagtggatttagggagattttagtatgagtatgtgtttaaagatgtttagatgaggaggtgttgtgggggaggggggcgggaatagtaagtttttttagttttgtagatttagattttttttttttttgggaagtagggatgtaaagggatagagtttgaaaaagggtttttattattaagttgataaagtaattacgatgtttttagtttatattttgtatagcgttagtggttattggattataattttttttcgttttttcgtcgttttatattttttttaggtttagttttgaagaatagttattggtattttgtttggcgtttagttaaagttttggttttttaggaggtttcgttttttttatttagatagggttgattttaggtgggtcgtgtgggtagttgggtttaggatatttagatgttagttttggttttggttatggagcggggaggattttaggttggttattttttagtttggtttgatatttggatagtttgtttattttaatatagtttttttttttttcggtttattagagggttttgtttaagttagtttaggagttttttcgaggggcgggggttttaggtttcggtagaggtaggttcgttttttagaagttttgttttagagcgttggagattattgtgtgagtttttttttcgtttgttgtatttattttcgcggacgtaggacgtagagttttagtatcggtagttaagaggacgtaggaaagcgtacgtatttataggtttagagacgcggacgttagatttaggtttggatagagtagtttcgtaagttttaatatattttgtaaatttcgaagataggagagagttaaaatattttttttgttcgtacgtaggttttttttgttttttacggttcgattttgggaggcggatgaggatatttttaggtttggatgggggttatgggatattttattttagattttgttacgatttgggttgtgttcgttcggtgttttcggtttacgggttgtataatttggcggtttcgaaattggcgtgggggaggggagggttgtttattcgagtaggacgcggttgtttatttagtcggaggtgaggaacgatttttttatttcgttgtcgggtttaagcggggttcgagagtcgtcggggagagttaaagggaggggatcgatggattttttagagtgaaattgtgcgttttggagagtttcgaggtagtttcgcgagttttcgaggaggtcgttgtcgtttggtaaatataaataataataaaaggaaggaaatttaggcggtagtgcgtagaacgagtatagggttttgtgagggcgcgtagggtttacgcgggtgtttttaatagggttttttacgtaggcggcgcgggtacggggtcgggggcgcgcggcgtttttagcgggagggcgtttggattaggggtttcgtttttttttagcgtattttcgtttttttttagcgtattttcgtttcgcgttaggtttattcgtagggttttttttagtacgttcgcggtcgtagtagttagtttagtatttattttcgaagttcgaaatgattttatttagttgcgcgttgatcgcggggttcgatatgatggttggtgggtagcgggtcgcgcggagggtagcggcgaggaagcgttttcggcggggttcgggttttgcgcgttggttggggcgtcgcgttcgcgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggagaaggtattgttcgggagaaggggtatagggcggggatggaatacggttgttagagaagttagggacgggcgacgtttttttttttttataataagggttttttgagagtaggaagtagattttgttaggagtagacgttttcgaaggaaggtgtgaaggaaggagttaggtagtgagtgagtagaaagggagttgttttaagggttttttttttttttttgggttttaatttgaggtttagttttttttttaggttagcggtttttatttttaaattatattatttataaggtaggtagggtcgaggggttggggtagatttggggatttgggttagatatagaatttgagaagtaataggtttttatttttaagaagggttttttaggtttgttatttataagagagagaggcgttttttttattcgttttggaaagttagaaatttatttttgtatgttttttttgttatttcgttttttagattttcggtttttgtttagagttaggggttatgtgagaatttatagtatggaataatatttttattttcgaagtagtaggtcgtaacgttataattgtatttcggttttttgaatgtgtggtcggggagcgtttgatagtttattttgggtttgaggtcgttcgttgtttatttgtttttttttattttttttgaaatattttaaatgtgtaggagtgttgagattttttagttattttggagaggcggggggtagggggttttttgcggaaaatgttttaggtttgggtggttttttaagtagatgaaattaagttttttttttttaagaaaagtaggtatttttttttttatgttttggatattttgaattatttttaattaagtgagtttgtggatatgggaattgtaaaattatagatattttagatgcgtgtatattttcgtcggtttgggagttcgggttttagaaatgtagttattgttgttattaatagtatttcgtattttttacgttaggttagggtatgttttgtttgaattttagtatttgggtttatcggatagtttagtttttattgggttatttgtttacgtcgtatttggggatttgggggtttagtatttaagaaatttagtttaataatatagtttttttgggaagatgtcgggttcggtataatagttattttaagttatagtattattttcgagtgtttttttaaaaagtatttggtgagtgtggatatatttatgtaattgtttttttttagggttggtatggagttttattagattagtatagggttagttaattgtatattttttatttttacgtatagtgtagtaaatatatttagttttttggggagcgtcgttagggtgtacgttttattaaaatgggaatttaagggataatggtaggagagtagttagaaagtgcgtatgttttcgtgattgtgtttagagtttatcggttttagttttagttattgtttttttaatgtaattatttagagttatatgattaggtttagaaatttttaggtaaggaggtttttcgagtttttttaggaaatttaaattagggtttggttatatttttagttaggaagtttattttcgtatttaattaattgttttaattgtatattatttattttttttttttttttgtttttagaggagatgggaaatagttgggtattattttttaagttataattattttttttatatttaaggataatttagttgttttttggtttttttttttttagtttaaattatttttttttagttttttaattatatttcgagttgttttttgattatagttaagggttgggtttagtttggggttttaggattttaatgaggttttattgttataggatagtgaggaggttttttattttttttttttagggttttagggtttggatatatagttttagaaggggtattgggtagagaagatgtacgtcggtagtagagaggaaattgagttgaaatttggtaagaataaaagaattataaaggtttgtgtatttagtaaggtgtatttttttacggttataaaagaaggtaagatcgattgtaggtttggttaaagggatcgtttgcgtttttagtgtataacgagatttatagtgggtcggtgattttttttaaaataaagatatgtttatttggaattttaaatgtgatttgattttgtttaagggtttttgtagaaagaatttaggtaaggattttaagataaggtgggttttaaatttaatgttgtgtttttttaagagatagaaaagaaagtatagagatatagaaaaaggttttgtgaagatagaggtagagatcggagtgatgtagttataggttaaggaatatttggggttattagaagttggaagaggtaaagaaaggtttttttttggagtttttagaggaagttggttttgttggtattttgattttagatttttggtttttagaattgtgagaggatatattttttttgttataagttatttagtttcgatagttgttatagtagttaggagaaattcgtgttttatttttatttgtattatgttttgaggttaaagttttatatagtaaagatgtttaagtaattataaattttgtgggtagtttattcgtttagtagattattgttttaagggaagggggatggggatagggaagagagttataggaaatttttgtacgtttttttggaaatgggaaggagtaggtttggagagaaattttataggttaggtttcggggaaatgaagtttataaagcgtgggaacggagtggggaggaaatttacgaggaagtagcgtttggcgtatatatttatatttatgatttttttttaggtatagtttttatggagaggtttagttggtagggaagtaaaagaggttcggagagcgaaggaaggtgaggggtttttttttagtaatattgaggttttagacgggatattttattaggtggtaggttgtgtttttatagatagagattttttaagggtagggtttagatggttttatttttgcgtggtttgatataaagtaggttttttagagttgtcgagttttgggttcgttagtggtagagttttttatagttttttaagtttttatagttttttattttaggaaacggtgttattatttatttagttgtttaagttaagttttcgggtattattgttgattttttttttttttttatttttagtatttaaattatggtgcgtttttatttttagtttttttgcgaattagtttgaattttttttttttagtagtgtgttagttaacggttaataatcggttatttggggttagtaaaagtaataatatttagtttttcgatttgtagcgtttgtttatttttgtggtgttaatatttttgttttggttaattttttttttttttttttttttttgatagggttttattttgttattcggtttggagtgtagtggggtaattttggtttattgtaaattttattttttaggtttaagtgatttttttgttttagttttttaagtagttcggattataggtattcgttattatttttggttaatttttgtatttttattagagatgaggatttattttgttggttaggttggttttgaatttagatgatttgtttgttttggttttttaaagtgttgggattataggtatgagttatcgtgtttagtcggttaattttaagttatttgtatgatattattggaggtgagattgagaagagatgtttagttattacgaatatagtgtttttattatataaatataattttaagaatataatcgtaataggatagataatagttaaatgttgtaaaaaatttaagaggtgatgaaagttgtgtatttattattttttgttttaaatataattatttataagtaattttttaatgttttgtttaattttttttttataatttgtaatttaatttatattgtaaaaatttattatttttttaatagagtaatgtatttttattgtgataaaatatatgtaatataaaatttattatttttggttagttattatggtttacgtttgtaattttagtattttggaaggttaaggtgggtggattatttgaggttaggagtttaagattagtttggttaatatggtgaaattttgtttttattaaaaatataaaaattagtcgggcgtggtggtaaacgtttataattttagttttttgggaggttgaggtacgagaatcgtttgaatttgggaggcggaggttatagtgagttaagattacgttagtgtattttagtttgggcgatagagcgagatttcgttttaaaaaaaaaaaaaataaaaataaaaaagataaatttattattttaattaagtttttatgttagtgatattaagtatatttatattgtatatttattaatattatttattttcgaaattttttttaattttttaaattgaaattttgtttttattaaataataattttttattttttttttttttagttgttggtaatcgttattttaatttttttatgaatttgattttatataagtgaaattatataatatttgtttttgtgagataggtttacgtagtatgaggtttttaaggtttattatttaaggtttatatgtagtgatagaatttcgttttttttgaaggttgaatgatattttattgtgtgtatatatattttgtatatttattttttttatatttgagtaattgagagtaaagttgttataaatatgggtgtgtaaatatttgtttaagtttttgtttttattattttattattattattttatttattattagtattattattattttagatagttttattttgtcgttcgggttgtagtgtagtggcgtgatttcggtttattgtaattttcgttttttagatcggagtaatttttttgttttagtttttcgagtagttgggattataggtattcgttattatgttcggttaatttttgtttttttagtagagatggggttttatcgtgttggttagggtagtttcgaatttttggttttaagtgatttattttttttagttttttaaagtgttgggattatagacgtgagttattgcgtttagttattattttagttttaaatattatagtaatttttttattgttttatgagattttttgagatagtggttttagggattttatatatatttgttcgattttgtgtaatgataaagcgtagttttttttgtagaatggtagagtcgggagatttttgatggggtatgagtttaaaggggtagaggggacgtttagaatatatatggattttttatgtgcgttttgttagttattaagtagatttgttttagtttcgatatgtttaggattatagatagtgtatggtttttatttgggttaagttttcggaattttttttttttttatattatttgtattgggagtagttattaggttgtggattattaagttttttttaggttatttgagtttgtatttttttatttagtttgattgagtcggtgtgtagttattatattttattatattttttgtttggtcgttttaatgtaattataaggttttatttaaagaagtatatgattaatttgttttttagattttttagtgatttttttagtttgttttgtgtagaatatttatagtaaaatttgattatagcggtttgagtttttatttttaaggtaggggattttttaaataaagtattagtgttttaaatttatgattttttaaggaggtttttggtttttagtatagtaaatgttttgttttatggtttttcggttttttatttttattttattcgagtttttcgtttcggtatttgggattgaattagtttggagttttttagttttgttgtttgttggttttgatgatattattagggattgtagtattgtttggattttttgttgttatattttattgtaataatatttaatttgatggaattttgggagtaagtggtaggggtagggatggtggtggttaggggttgtatatatataggatagaaggattgaaggattgggtggaaagtatgatttttttaagatgatttttttttagtagaattttggttgtgttttttgaatagtatttgtttatttgtatatttggtgagttttgtgattagtaaatttagatgtttgggaggttattagcggttttgttgaggtataatttagatatgatagtttatgttttttttttgatttttttttttttatatagttttatgattagagcgttttttttatttttgtttttattttagtttcgtaagatatagtcgtgaaatggttaaagtttttaattttttagtattcgtttgagattggagtataaaaatgagatggggatatagtattttatggatattagtgatggaaaaaaattttttgattttttcgggagttttgtaaagttatattaggggataagaaggagtggttagtttggtatcgatttagttttaaagtagttagtgattaaagtatatagttggtatttttttatttttagggtattaggaggtttggttagaatttatgttagttaggagaaataggttgtttttggggtttttggtgttttggtttttttattgtttttttgaagaaggtattttgttttgtggggtttgaggttggaggtaatttgttatcgatgtagtgtagggatgagggttgagttattagtttgttttagttttacgttagtaggaataatagggatttaagtagagaagaaagtatttatttttaaagttattatagtgattgaggcgacgtggtttttagggagtttttttttttgttggttttttgtggatcgcggttttatgttttaataatgtttttgtttatttcgtaaggtttagtaggtggaaggaaagagggtggaggttgggagtggcggtttggtaattcgggaagggtagggagtaggaatatgtttttttttttttgtattcgtttagaaggttttatagggtttgttttgttatttataattttagggagatttttttttaatgtttgttttataaatgtttatttattttatatttgaatatttttagttatagggagtttagtatttatttatgttatttattttatttttggttgtttaaaaaagaggaaagagagagaaagaaaagataggaaagatagagaaagggggaaagagagagagaggaaagaaagaaagaggaaagaataagataggaaggaaagaaaaaggaagggaacggaagggaaggaagagagggaagaaagagagaaagagagagaaagaggtataaataaggtaggttttatggagtagagatttaataagggagtaaaatatatttgtagttaggttgtagatggatttttataggagcgtatatttattttatttttttcggaatagaaaagtggaaagaagatgtagcggtgtgggtgggtggcggttttttttgggggtttggaatgtggggtattagtttttttggttttgagaaggagattaagattattaatatttatagtggagatcgaattatataagggttggggatatcgttttttttgtatttttaataaagattcgatgttttaattatgggaatttgtggaagaagaaataaaattggttttggggttttttagagaattggttttttatttagtggtggttgtgaagaaatttttggagttagttttagcggtttgggtttgtatagttgagattgtttttggaagttgagtggaagtggggagtttttaggtatagttgggttttgttttttattttagttagtagttttaggatttttgggtgttttagagttttttttagagggtaaatttagagtatgagggagcggggagatgtttaatattgggggatttttgttcgtttttgtttttagtttcgttgatttgaatagggaggttatgggtgtttaggggtagaattgtgggttggtaagtttttagttttggtttttttttgtttttttttttttattgttattgattatttttggttatatgttgatatttttataggatgatggagaagagagaagaggaattttttcgttttgtttagtatattttaaagaggttttagtgtaaaggtatcgacgtttatagttaaatgtgtgtgggggttttttaggagtgggacgtttttatttcgttttagattgttatgaatcgatagaaggttttatgttattaaatatattttattaataaattattttaatatttagtaaaaaaataaataaaaatgtatgtatttcgtgttttgtagtgtttttatgtcgtatttttttttgtatttgagtttcggttcgcgtttttggtttgtcgttttgggaatagaacgttttgcgtgggaggtagataggaagcgcggggtgcgttggttgggtttttttagataatttggtattgttttttttagataatgaaattttttttattttgagtgtttttggaagttagtcggtagttagattaatttaaatgaattatttgttttttttgtgaagtgattttagggatttaatgggtttgttattaatatagtttttttcgtattttgttttttttttttatttttttttttttgtatgagttattggttacgatgattcggtttagttaagggatttggttagttttggttaggttatgtgagagatagtataaaggattaaggttgtcggaattaggttagaggttgagggttatacggattttttggagtgtttgtaattggggatttttaaggttgttttttggttttggggatttgtttatttggggatagttttaagggagatttttaaaagtagggagttaaaagggtgaattaatatagaaatattgagggttagggagaatttgaagatgggttcggttgggtatagtggtttatgtttgtaattttagtattttgggaggttaaggtgggcggattatttgaggttaggaattcgagattagtttggttaatatggtgaaatattatttttattaaaaatataaaaattagtcgggtgtggtggtaggtgtttgtaattttagttatttaggaggttgaggtaggaggattgtttgaacgtaggaggtagaggtggtagtgagttaagattatattattgtattttagtttgggtaatagagtgagattttattttaaaaaaaaaaaaaaaaaaaaaaaaaagataggtttaaggtttggagagttagaagttatttttttatttttgggtggtttattttgagattgtattacgttagagaaagttgcgggagtgtttgtttataatttataagtaatattgttttttttttttattagtttttggttttagtaggtttttgattcgtgttttttttagggttttgggtttttttaagttggattttcggttgttggtgggatgattatgtgatttgttatttttttgtttatcgttttgggtagtttttgttatttggtgtatatagagtggagtttagtaaggtcggggtcgtcgattttttgttagttatatttgtttttttttacgttattttttttcgttttggttatgtttaggggtttatatttttttataagttaggtgttagatttttgtgtttgttttattttgttttttttgtttggtgggttttttatattttttttggtttgatttaggtttgatttgtttttaggttttagtttagaggttgttttttttaggaagtttttttgggatcgttagatgaagggatttttttttggattttttttttatttttatagttttaggaatagtttttaatttaggttttattgagttagtgtggtatttaggagagttataagcgtgtgacgaacgtgttgaagtttttttaaaagttgaaggagttttgtgaatatatagtagtattagtttagattgcgaaggtataggggagttagttttttttagtttcgtttgtttttggttttttttttgaggaggtgggagttagttagttgggattaggaggtgggttttatggagtagagatttaataagggaataaaataaattagagaatttttttgttgtaaggaatttagataaggagtatttagttagaggaggaaggaagagatcggtagtagattttttttgttttagtagttttgtaagttagatgggttaattttttagtatagttgttttttagtatagagaaattttttatttttagtaatagggtgggaatatttttagatagggttacggttattttggttatagggattacggagtttgagtttttgtggtttgttttatttatgtggttatagattttgagtatatatttggagttatagagtttaaagggtagggtagggtagggaatttgtttgattggtgaaggttattttattatttggagtataggtttttgtttttaaatttatatggagttttcgatacggggtatcgattttaaggaggtgaatgtggatatttaaggttagtgaatggttaggtgttaatatatcgataggtttttggttttttttttaatattgagggtaggaaataaatggggtttatatggtgtatatggtttttagagttagtaaggtgtgtaagattcggtagttgagaaaattgattatttggtcgggcgcggtggtttacgtttgtaattttagtattttgggaggtcgaggcgggcggattacgaggttaagagatcgagattattttggttaatacggtgaaattttgtttttattaaaaatataaaaaattagtcggacgcggtggtaggcgtttgtagttttagttatttcggaggttgaggcgggagaatggcgtgaatttgggaggcggagtttgtagtgagtcgagatagcgttattgtattttagtttgggcgaaagagcgagattttattttaaaaaaaaaaagaaaagaaaagaaaagaaaattgattattcgattatgaataagttagaatatttatttagaaaaaaaaaatagttttgtttaattggggatttaaaattttaggatttatgttttttttttatagagttatattatttttttaatgtttattttcgattttatttgtttgttaagttttaggtatttagaatatagtatgatagtaagttttgtgatttttataggtttttttaatttattttaggtatagttatatttttagttttgagtagtagggagtgatatgtagatggttatttagatagagaaagatttttaaaaggagggtaggttttgtttcgtaggtagtatttattgatatagatattagtaggtaaattttttaggaagatttttattaagaaagaacgaaagaggtttagtgcggtggtttacgtttgtaattttagtattttgggaggttaaggcgggtggattattttaggtaaggagttcgatattagtttggttaatgtggtgaaattttatttttattaaaaatataaaatttagttggacgtggtggtgggtatttgtaattttagttatttgggaggttgaggtaggagaattatttgattttaggaggtagaggttgtagtgagttaggattatattattgtattttagtttggggggtaatagagagagatttcgttttaaaaaaaaaaaaaaaaaaaaaaaggatgaaagataaataaggttgaaattggtaggttggtatatttttaataatttattttaggtcgggcgtagtggtataatgttagtattttgggaggtcgaggagggtagattgcgaggttaggagatcgagattattttggttaatacggtgaaatttcgtttttattaaaaatataaaaaattagtcgggtgtggtggcgggcgtttgtagttttagttattttggaagtttaggtaggagaatggtgtgaattagggaggcggagtttgtagtgagcggagatcgtattattttacgttagtttgggcgatagagcgagatttcgttttaaaaaaaaaaagaaataaaaaataaaaataataaaaaaaaaataatttattttagtagggagtaggaggtaaggtttgatatgtagtgtttgttaatttttgtggtgtaaatatatttattgtggtaaattttaagttataaataggatattattaaatatagagttgggaaaagatatgtatattattggataaaacgtttaggtagttacggtttatttttttttgggaaggggggtatgtttagaatgttttttattatggagaatgattgtggtaaatagggtttaattggtaggttgatttaattaattgtttattgatgtgatgtggggtaggtttttgaggttgtttttatgtttagggaagaaggtggttatgtggttatagatttggttttgggtttgttttttttttttttttttgagatagagttttgttttttttttttaggttggagtgtaatggtgtgattttggtttattgtaattttcgttttttgggtttaagtaatttttttgttttagttttttaagtagttgggattataggtgtttattattatgtttagttaattttgtatttgtagtatagatggggttgttggttaggttagttttaaatttttgattttaggtgatttatttattttggttttttaaagtgttaggattataggtatgagttattgcgtttattcgggtttgttattttgaggatatatttggagttatgtgtttatgattttttttttattttaaaattttgattttattttattgtttttagagataggttttgttttgttatttaggttggagtgtagtggtgtaattatagtttattgtagtttcgaatttttaggtttaagcgatttttttattttagtttttcgagtagttggggttgggtttataggtgttattatatttagttatattttatatttttttgtagagatagggttttgtaatttgtttaaattggttttaaatttttggttttaagtaatttttttatttttagttttataaagtgttgggattatagatgttagttagtgtatttagtagttattatgattgattggtgacgtttgttttagttttaggatgaaagagtagtagtattttagttaagtatttgtggtttttgattggaagacgttttttttgttttttaagtatagtgtaaatgttatttttttggtaagtttttttttaattttattttttttttggtatagggtttgttatagttttgtttatataaagagagttattagtgtatgtggtatagatgttagttgtttttttaatatttgagtttttttttttttatagtaattgaagttttggttgtgtatagggaagtttagttgaagaatatattgtttagtttttttgatgataggagcggttatataattgggttttggttagtgggaaggagttgaagtgtttaatttttaggttatgtttttaaaaataaagagggatatttgttttttttttttttttttttttttttttttttggttggagtgtagatatgacggtaggagttggaattattttagtttaagagatggaagttgtgtgtcgaggatgtattaaaggaatgaattaggttcgggttgttttgggtttttataacgattgatatttggattgggacgtgggttcgagtgttgtttagtttttgatgttttagtttttgttatatagttagatggtgttttgattaatttaaggtatggttattattttatttgtttggtagggtaggggttttatttttatacgttgagtttttggtagaatttggtgtaatatatatagttaaagtaaaatgaataggttattttaattaaggtttattttgtgggttggttttggtatttggttttaatttttattttattttatttatttattatttttgagatagagttttatatttgttgtttagtttagagaggagtggtgcgatttcggtttattgtaatttttattttttaggtttaagtgattttcgtgttttagtagttgggtagttgggttttttttgagtagttgggattataggtgtacgttattatgtttggttaatttttgtattttttgtagagatggggttttattatgttggttaggttggttttgaatttttgattttaagtgatttattcgttttggttttttaaagtgttgggattataggtatgagttatcgtgtttagttagttttggtatttggaattggaaaataatagtttgagttttagaggggataaatataaatatgaggtagaaggaatagtaagtaaatacgtgtttagagtaggttgggttgtttatatttttaaaatatcgttaggtgttgaggtttgggttttgtgttagatttttgggtgtagatttcgtggggatatttattgggtagtgggatttttggtaagttatattatttttttgagttttcgttgattaagttgtttattgagaataatatttagattgaaaggatttataataatatgtgaaaagtgtttggtttaaaataggagtttggtaattggtagtttttattatttataatatatagtttaacgttttcgttttataggaatgaaaataggatttagataggtaaaatgatttgttgagggtcgtatagtgttaatgatagagttaggattagggtttggggttttgattttttttgtagtattttggttttgtgagaagtggttttgggtgaatataaggagtgaggagttggtgagaaattttgaaaatgaagttgggtgtggtggtggatgtttgcggttttagttatttaggaggttgaggtaggaggattgtttgagttcgggagttggaggttgtagtgtgttatgattgtattatcgtattttagtttaggtgatttagtaagattttattttagaaaaggaaaggaaaggagaggggaggggaagggagggaatttttgatagtgattttagagataattaggatgatttgaaattattttgaaatgtattaaaaaataaaaataaaatggatttatggttaggcgaaggagggatagatggacggtgaggtgataaagtaggtgtagtttggtgttagtggtagaatttaggtgatggttgaatgtgttttttgtaaaatgtttttaatttgattatgtgttttgaatatttttataatagaatggagggaagagaaaggtaagagggagttattgtagttgttgtagtaggagtagattttaaaatattatgtattagatttttagttttgtttttgtggatgtgtttttgtttttttttttgggatttaaggatatttaatgagcgtatgtgtttttaagtttttttgtttttttatttgtttttatatttggaagattttataggtggcgtgggttagttttttattttgttttttgtgtttttagtgtatgatagatattgagtgagtgttagttttttttttcgatattttgtttgtttgtttagagaggtttttttatagtttagttattaggttgatgtttttggacgtttggtcgatagtttttttagttgtgttttagtgatttggtaggtgttttgagttataaataaggttattagtggatgtttttaaagttttttttattacggcgttttttttttttttattaatagttcgttatgatagttagtttgtatgagtttttttttagggttgtgttttttgaggttgtttagcgtttggtttgttagagtttattagatagggtgtttattttttttaggtttgagtttttatttagagaattatttatagaaggataatggagaaaggtagttggggtattaaatggagtgtgtttgtatgtggggggggaggggagggggagggaaagtaggaagagaagatataagaggagaaataagaataagaggaaatatagaaggaggaggagtagttttttttatgggggtggattttgtgtttagttttttattaaggatattatatttattatttcgtttggtttttacgaatatttttaaggtcgtttttttttggtttttatttttttattaggaagcggaggtatagagtgagaaagagttgtttaaggtttttaggtagtttacggagttattgggagttatatttaattcgtttaattttacgtttttgtttttagttattataataaattattaaggttttatagttataggagtttagttcggagtttttatcgggttttttaaggtagggagatggggttggaggttatgttaggtgtacggtgtttagagttgtttaggaagtttcgcggtgcgggttgggtattaggtagtgtttgtaggatggagaaatgaatgaggttgagatatagtgtcgttttttttaaacgtgattttttttgagtttttgtgattggttatttgagagggtagttttggttttttggcgtttatgttcgggtttagagatgttttttttagttaggtttttttttgaggatggaaatttagaattttattataggaggaagagttgggagtattttattttttttttttttttgagacggagtttcgttttgtcgtttaggttggagtgtagtgacgcgatttcggtttattgtaagtttcgttttttgggtttacgttatttttttgttttagtttttcgagtagttgggattataggtattcgttattacgttcggttaattttttgtatttttagtagagacggggttttatcgtgttagttaggatggtttcgattttttgattttgtgattcgtttatttcggttttttaaagtgttgggattataggtgtgagttatcgcgttcggttagggagtatttttaagatttttgcggagggttgtttaggtttaagttttttattatggaaggttttttagatgcggtagttacggtgtatgggttgagggtttttatttattaagaagtaggagtatttgatgtatatttagtttacgatttttatttatttgggggttgtgtttgtagttacgtgatataagggaatagttatagtagtgggttataaagagagtgtgggttaatgtgtaggggtagaattttgatagttttttatgggttggtagtagggaggggtatatttgtataaattttatacgtatagttttttatatatatgtggttgataattatttatatatttaagacgggatttggcgtatagtttattagtaataggcgttggtaatttttagttgtttttttgttgcggcgtagatattatttaaggtgggatggagagagttattgtttttaaggttatatattttaaagggagatgttgggttacggaatgaaaataggaggattagttagagttattggttttgagttatataatgggatatataggtttatttattttatatttttattgagtaattataacgagttaagttgtatagattatttaaataatcggtacgtagaaaagtattttaatttttttttggttttgacgtgatgggaagaatttggatttttggagttatagagttggatggaaattttggtttagttaattattggttgggggagttcgggtaagtgatttaaggtttttgagtttgtttttttgtaaaagagtagtgttcgggtttgttacgttaggttagggtaagatgattgaagagtaagcgtttagtatcggttaggggttaacgtttttaaggacgtaaagtgtaataagtaggcgttacgattgtatcgttttttattgtttgtggtaaatatataagtaaagatggtttcgcgtttgcgttgggggaggtagggaattggttttaggaggacgttggtttttttagttgttttttttaaagttttttgggaggagaaatgatttattttagttgttgggagttttaatttataagtaggtttgtttattcggtagcggtcgtatgtaggtaggaggggtttcggtagtttttaagagtgaggggtcgtttagtttttttttagttggaaaggaggttttaggttgggtaggagtatttggggaaatttagtttttggagttaggttatattagggagatgaggttgttagaagtttttttggtgtttatagtaaaatataattaaagtgggatttagattttaattagtttaaggtttgatttatattagagggaaattagcgtttgtcgtatgagtgagcgtttatgtgcgtgtaaggtagagatagattttgggtaagtttttttatttttttacgtttgtttttttatttataaaacggggtaatattatttattttatagggttgttatgaaataaatatgtattaatatttgtaaagtgttgagaatagtatttggtataaaataagagcgatagatttgttaaataagtaaaaaataagatataagtttaaagtagagtttggtatatcgtgagtattaagagttgtgttttttgattttttttttttgtggagatttttttattagaagtgggagggattgtcgaggttggagttttgttttagggatttttgtggggagttttttagtttagagggatttgttttacggattatatttgtttcgggttttcgtgtttttgtgtatgtgtgtatatatgtgtgtatatatatgtaatgtgcgtgtgtgtatttttatggatttgtgataatttgtatatatatgtttagaatttatttgatatagtgttttattaagatgttggagtttcgatgaatggattgcggggttgagatattgtttttataggaagttgttttagtagtaagttttttggtttttatagataattaaaaagaatggagtttgtttttattttttgttttaaaaatgatgtatagtgtgtggggtttgatgttggaggtttttttagtagatatatttttaataatattatattttgaaatttaagttgtcgtaaaataagataagtaaagatggtattggtagggatttttgaggttttttttatgtatttttgaataatttttatatggtttttgtttgaatgtttttaggtatggggaatttattattttgtgaaatagtttgttttatcgtttttaagtgaatattgtgagaaaaatatttttttttgtaaagagttaagttttattcgttagtattttttaggtatttggtattagttttatattttgggggaatttaaaataaatgttttttttttattagataatttattaattatttggagatagtggttgtagttttttgttttatgtagttattttatttagtttttttttggaatttttgacgtgaatataagtttttttgttacgtaggttttttttttgggttttttatttatttgcgtatattttggagaggtcgttcgttttgtgggtgagatttattgtgggttgaattgtgtttttttaaaagatatatgtaagttttgattttttagtatttatgaatgtgattttatatggatatagggtttttgaagatgtaattgggttatttgagggtatattgaattagagtgggttttaaatttaatgataggtgtttttataagatagaggtaggttgggtatagtagtttatgtttttaattttagtgttttgggaggtaaagttttattgtttgagcgtaggagtttgagattagtttgggttttcgtttttataaaaaaattaaaaaattagttaggtatggtggcgtgcgtttgtgttttagttatttggaaggttgaggtgggaggattgtttgagtttgggaggttgaggttgtagtgagttatgattacgttattgtattttagtttggaggatagaatgagaatttgtttttaaaaataaattaaaaagataatagagagggtagtttggatagagatataagaagagatatagggtgaaggttaggtggggggtaggtcgagttgtaagtcgaggaatattaggggttgttggtcgtcgtagagttcggagaaaggtatgggatagtttttttcggaatttttaggaggaatgaatttttagatatttcggtttgggatttttggttttagaaattttagggaagatatttcggatgtttttgtttttgtttttgtttttgtttttgagacggagttttgttttgttatttaggttggagtgtaatggcgcgatttcggtttattgtaatttttatttttaaggtttatgttatttttttgttttagttttttgagtagttgggattataggtatttattattacgttcggttaattttttttttttttttgtatttttagtagagacggggttttattatgttagttaggatggtttcgattttttgatttcgtgatttaatcgtttcggttttttaaagtgttgggattataggtatgagttatcgtacgtggtcgatttcggatgttttgagttattttatttgtggttttttgttatgatagtcgtaggatagtaatatagggttttagtagggtggttcggtaagggttttttttttacggtagtttttattttgttttatttgtagggttatttagatgtttatttcggttttggttagtaagtgttagtgtatttttttacgtttagtagtaagggtagtatcgttgttgattaagtatttgttatgtcggggtttttgtgtggttttggggttttttttttttgtttatatttggtagtttagtttttttttttgtattttatttgatgtcggggttttgggtaagtttgggggatttgtgttttattttatagattttttagttgattttattagtttttgtatagggttcgtttgaagggtcgttgggttgggcgttaattagagtttttagtagtagttttttcggttttttgattttggtttatgttttaggggtagggtttttaagggttttggggtcgtttttgaggttagtttttttgttgatcgtagtttatatagaggagggtttaattttgagtgtggtcgttcgtgattttgagagatgtttagagttgtagacgtgttttttaagttttttagagttcgggataggagttatttaatgtttttagtgttataggtaaaatttgttttttttaatataaattgtttttagttttatttaatgttttttttaacgagtagtaataaaaatatggttttttgttaaaggtggggtttatagttttttagaattcggttttttgttaggtttaggtataatttataggagtgttcgtttttgattcgtgtgtgtgtgtgtgtgtgtgtgtgtgtgtgtgtgtgtgtgttgtgtgtacgcgtatatgtgtttgcgtaagtttttttatgtgtagttttgggaagggtggagaggtttacggaaattttttttggtatttagtaagttagaaaaaaggaaaatgagatttgtgtatatatgtgtaagtgtatatatagtatataggtatatatatatatatatttagtatatattatataggtttatacgtgtatatatgtgtaggtatatattatataggtttatacgtgtatatatatgggggtatatagtatataggtatatataggtatatatatttttttgtaggaaagtttttttttgttttttattttgtagggtttttaggttttatgaaataagattgaattttggaagtttgataaaaggtttgtttggagtattttggttatttttattagtttttttagttgtggaaggtatgtttcgtggtatttatttattttttgtttttatttttattttcgttttcgtttttttttttttgtttttttagtttatatgttgtttgttttaattttaatttttgtatttggacgggaattattttttttgtagaagggtgtaatgtatgtggggatatatatatatatatatatatatatattgtattggaggagagaagagaggtagagttttttttagatttagagttttagcgagtgacgggattttttttagagaatacgtgtagaagtttgcgttattggaagaagatattattttgatttatatttttttttttttttttcgttttttttatagagaaggaaaggttttagtaaatagtggttatgtgggttttttgtatgttattggtagttttttagttaggattattttttttttatttttggaagtataagaatagagagaagggtgagtttttgtttttgggggtttttttttgtatttttttggagttaattttagggttgtgggttgtataggaaggagggtttaataggtttttcgtttaattttgtttttttagtgaggagtcgatttattttgtttgtaaaagatgttggttgggatttgatgttgggtaatttgaggagaagagaagggggataggggttgaggttaggtttttggttttgaaatagttataatttttggggtagagtttaagggtgttaggttggagattttatattcggttagttggtagttattattttggtttagttagtggtttagggtattatagttatttagattaggaattttatttttttggattgtattaatgaggaaggttgagtttgtaggttttatatatttatggtaattttaaggtagagaggttattgttaattgagggttacgggtaggagttttgtgagtttattagtaagtttggaagattaaggtttttggttatagagagtagttgttatttggttaattttgtagaaaatattatagttttggataaaatatttgaaagaataaaataataatagtttggagttagtatagaatattttaagtaggtagaagttggagtagagtttatatttgatagaggggaataaaattagataagtttttggtttttggaggtttttttgtttagaggtaggtattgagtaattaaatttggataaaaagttttaaaagtatttagggaaaaataatatgtggtttataggggaatagttagatgaatgttgattttttgatagaaataacggaggttaaagatattggaattttatattttaaagttttgaaagaaaaaattgataatttagaattttataattagtgaaattatggtttaagaatgatagtaggttgggtatagtggtttatatttataattttagtattttaggaggttaaagtaggtagattatttgaggttaggagttcgagattagtttggttattatggtgaaattttatttttattaaaaatataaaaattagttgggtatgatggtatatgtttgtagttttagttatttgggaggttgaggtaggagaatcgtttgagttcgggaggagaaggttggtgagttgagattgggtaggagttttgaaattatattattgtattgtagtttgtggggagatagagtgagattttgttttaaaaataaaaataaaaataaaaaaagaaagaatgatagtaaaataaagatttgtagataagtgaaaatgaaagggaattagttgtttgtaaatttgtattataaaaatcgtgaagtaagttttttaagattatgggaaatgagattagatgggaatttagttttttaggaaggaatgaagagtataggatatagtaaatatatgggtaaatagaaaagattttgttttatttttaatttttttaaaatgtatggggttgtttaaagtaaaaatttttttattgtattgtttagtttataatgtgtatggatgtagtaaatatttaataattattatatataggatggaaagtggtaaatgaatttataggattgtttagtttttatattttttttttatgaagaaaaataatgttaattttaagtagattgtgaaaagttaagaatgtgtaatagaatttataaagtaattattaaaatagtaatataaagagatataattaaaaagttaaaataggtcgggtttagtggtttacgtttgtaattttagtattttgggaggttagggtgggcggatcgtttgaggttaggagttcgaggttagtttggttagtatggtgaaatttcgtttttattaaaaatataaaaattagtcggtcgtggtggtaggcgtttgtaattttagtatattagggaagttgaggtaggagaattatttgaatttaggaggtagaggttgtagtgagttaagattatgttattgtattttagtttgggtaatagagtgagattttgttttaaaaaaaaaaaaaaaaaaaaaatataaattaaaatagaattttaaaaaatatttaattaatataaaagaagttaagaaagtaagatgaaagaaataaatattaaagagtaaggtagtagttttaaatttagttatatttataattatgttaaatagaaatagtttgaatattttaattaaaaggcggaggttgttagaatgaataaaatagtaagatttaattatatattatttataaaagatgttgttttagtataaatataggttgaaattttttgtttggaaaaagatatattgatgttgtttgaatgatgatggagttatgttttgataaatttattataagtggaaaataaatattattttaaaaatgtatttaatatatttaatttatcgaatattttagtttagtttagtttattttaatatgattagaatatttattttagtttatagttgagtaaaattaataaatataaagtttattttataataaagtgttgattattttatgtaagttattgaatattgtattgaaagtgagaaatataatggttttatatatatttaaagtatagtttttattgtatatatattacgttcgtattatggtaaagttgaaaaattgtaagttaaattattataagtttttttataagtttttttagtttttttatgtattttaaatagtatgtttaagaaggttggagaggttatataaatattaataaagttgagtttaagataaaattattacgagataaaggaatatatttattatggttaaatgattagtttatcgagatattattataattataaatgtgtatgtatttaattaaaggagttttaaaatatatgatataaaatttgaaagaattaaagggagaaatgggtaattttataattataggtggagattttttttttttttttttgagacggagttttatttttgttgtttaggttggagtataatggtgtaatttcggtttattgtaatttttattttttgggtttaagcgatttttttgttttagtttttcgagtagttgggattataggagtttgttattacgtttagttaatttttgtatttttagtagagataaggttttattatgttgtttaggttggttttaaatttttgattttaggtgatttattcgttttggttttttgaagtgttgggattataggtgtgagttattgcgtttggatgtatagttggagattttaatattattttagtttatttaggatgttaaaataaaatgttttaggttgggtaatttataaatagattgtagtgtttatagttttagaggttgggaagtttaaaattagggtgtttagtgtttggtgagagttagttttttgttttagagatgttttttttttgttgtgtttttatatggtagaagggattaattttatttacgatgattttgtttttatgagttaatatttttttgatgttttaatttttaatattattgtattagagattaagttttaatatatgaattttgggggatataaataggtaggttatagtaaatattatttttttaatatttgagaaataagtattagataatttgaagaatattggtaattagtaattgatttaattagtagttataaagttttatatttaggaagtttagaatatatatatatattttttttttaagtgaaaatagtgtatttattaagatatatattttgggttataagttttaaattttaaaagtatgtaaaatatgtttgtttggttaaagtaagattaaattagaaattaatagttttaagatatttagaggagttttgattatttgtaaattaaataatatatttttaaataatttatgagttaaagaggaaattataagaaaaattttataatattttaaatgaaatgataatgaaaatatagtatattaaaatacgtaggttgaagttagtgtttagagggaaattgtaagtgtttatattagaaaagaagtaaaaaaaaaaaaaaaaaaaaaaaaaaaaagatttaaggatttgttttaagaatttggaaaaatgggttaggtgtagtgtagtttacgtttgtaattttagtattttgggaggttaaggtaggtggattatttgagattaggagtttaagattagtttggttaatatggtgaaattttgtttttattaaaaatataaaaattagttgggtatggtgggtatttttagttatttagaaggttgaggtaggagaatggtttgaattcgggaggtggaggttgtagtgagtttagattatgttattgtattttagtttgggtaatagagtaggatgtttttttaaaataaaataaaataaaataaaataaaataaaataataaaaaaaataaagaatttggaaaaatatgttagttatttatgtattgttttttaattttgtatatattttgttaggtttcgtttcgtgatattggatcgaggttttatgagtttttttttttggttaaatatagttatgttaggttttatttataggggataatattgtggggagttgttaggttttgttgaggtagtagtttttttttttggttttagggttttttttttttttgaaggtatagttgttagtggcgtgtgtttagtggggtttgttttgtattgagtttttttagtattttagttttagtttaatgggattttagtaaattttttagatatttagtttttgtttatttatattttttagtaggtttttcggttatttagtaagttgattttgtagatttattttttttatattttttggtaagaatttttttgttattagtaggttgtaggtttttgtggtagttatatattttttaataaggtttgaacgtaagacgtggtaaggtgtggaggacgtttcgagtttttggttttttttttattaattttagtggtagtaattgtttttgtgtgtttgtatatatgttttaaagtatttattatagaaaatttattattttaattatttttaggtgtgtagtttggtggtatgaagtatatttatattgttgtgtaattattattattatttattttatttttttaaattgtaattttatttttattaaatattaattttttatttattttttttttttttagtttttggtaatttttattttattttttgtttttttgaatttgattattttagggattttataaaagtgaaattatatagtatttgtttttttatgtttggtttttgttatttagtatgtttttaaggtttatttatgttatagtatgtgttagaattttttttttttttttttttttttttttttttgaggtagttttgttttgtcgtttaagttggagtgtagtggtatggtttcggtttattgtaatttttatttttttagtttaagcgatttttttgttttagtttttttagtagttgggattataggtatatgtttttatgtttggttaatttttgtatttttagtagagatagggtttcgttatgttggttaggttagttttaaatttttgattttaagtgatttgtttatttcggttttttaaagcgttgggattataggcgtgagttattatatttggttttttttttttttttaaggtagaataatattttattgtatagatggattatattttgtttgtttatttattcgttggtggatatttgggttgtttgtattttttggttatgggaaaagtgttgttataaataagaatgtagtatatttgtttaagtttttgttgttagttttttggagtatatatttagaagtggaattattggatgttatggttattttgagtttaattttttgagtaattgttatattttttttatagtagttgtattattttatatttttattagtagtgtacggggttttaatttttttatatttttgttaatatttgttgttatttatgttttggttaatagttattttaaagggtgtgaaattatattttattgtggttttgatttttatttttttgatgattagtgatattgcgtatttttttttgtgttttttggttattggtatgttttttgtggaaaaatgtttgtttattgggttgtttttttttgttttgtggtttagttgtaggagttttttatatattttggatattagttttttatcggatatacgatttttaaatatttttttttattttgtggattttttttttacgttattggtagtattttttgatgtataaaagttttaagttttggtgaagtttaatttattatttattttttttgttgtattttcggtgttatatttaagaaagtattgttaattttaatgttacgaagttttttttttatgtttttttttaaagtagttgttttttatatttgttttttttatattttttagagtttttttgtataaggtaaaataaattttatttttttatttttatttataatatttagtgttttagttttgatattagatgtgtggttttttttcgtcgatttttaagtaattttttaatatttagtagtttttaattgggtgttttgtaatttagtttaattttgatattaattagagttagtgtagattttataggttaagggttttattttataagattgtttttaattttagagattagtcgtaagtggtaagatattaggttatttataatttttgtttgatttggttataaatttgaggtttttataattttttttttaggtttaataatttgtttgagtgatttatagaatttaggaaattagtttatttaaaattgttgatttattataaatgatattttaaaggatataaatgaatagttaattggaagagatgtataagaaaggtatgaaggaagcggtatggagtttttacgggagggtatattgtttttttagtatttgtaggtatttaataatttgaaattttataaattttatttttttgggtttttagggaggttttattatataagtatgatatgaaatttttggttattgatgattaatttaatttttatttttttttgtttcgtaggaggtggatgggaaaggttgtaagttttagttttttaattataaggttgggttttttggtaattagtttttatttttaggttgtttaggagtttttagttattagtcgtttttttagtaaataaaaagatatttattattttggagattttaagagttttaggagttatatgttaaataaagttgggggatagagattagatagatagatagatagatagatagatagatagatagatagatagatagatagatatattgatttttgagatagagtttttttttgttatttaggttggagtgtagtagtgtaatttcggtttattataacgtttgttttttcgggtttaaattatttttttattttaattttttaagtagttggaatcgtaggtatatatcgttacgttaggataattttttgtatttttggtagatatgaggttttattatgttgtttaggttggttttaaatttttgagtttaagggattcgtttgttttagttttttaaagtgttgggattataaatatgagttattgtatcgagtttagtttaaatatattttttttatattataatgttatttttttgtgatttttttaatagttaattattttttatagttaagaatattttatattataagttgttatttaaattgtcggtgtggtttttgttttttgattgggttttgattaatgcgttgaagtaagtataaggaaggaagtaatgaagataatagagaaatttaaggaaatggatattagaaaaggggagtttaatgttggttttttaaaaagatttagattgataattttttagttaggttgttgatgagagggagatggcgaatataaagttataataaaaggaatgaagtgttttttttacggattttatcgatattatagtgataaggaatataggtatattttattttattgtgttttatagatattgtattttttataaattgaaggttcgtggtagttttgtattaagtaagtttgttggtattatttttttaataatatgttaatattgtgtttttgtgtaggagtttgatgatttttgaaatagtttaaatttttttattattattatatttgttatggtgatttgtgatttttttttttttttttttttttttgtttttttttttttgagatagagttttgttttgtttggagtgtagcggcgcgatttcggtttattgtaagtttcgtttttcgggtttacgttatttttttgttttagtttttcgagtagttgggattataggtatttattattacgttcggttatttttttcgtatttttagtagagacggggttttatcgtgttagttaggatggttttaattttttgattttatgatttgttcgtttcggttttttaaagtgttgggattataggcgtgagttattgcgttcggttttttttttttttttttgagatggagtttcgttttgttgtttaggttggagtgtagtggagtgtagtggtgtgatttcggtttattgtaatttttattttttaggtttaagcgatttttttgttttagtttttttagtagttgggattataggtattcgttattacgtttggttaattttggtatttttagtagagacgaggttttattatgttggttaggttggttttaaatttttgattttaggtgatttatttgtttcggttttttaaagtgttgggattataggtatgggttatcgcgtttagtgattagtgatttttaatgttattattgtagttgtttttggggtatgacgagttatatttagataagatagtgaatttatttaataaacgttgtatgttttgattgttttattgattggttgtttttcgttttttttttttttgtttaggtatttttattttttgagatttaataatattgaaattaggttaattaataattttataatggtttttaagtgtttaagtgaaaggaagagttattcgttttttattttaaattaaaagttagaaatgattaagttgagtgaggaaggcgtgtcgaaagttaagataggtaaaagtgagattttttatgttaaatagttagttaagttgtgaatgttaagaaaaagttattgaaagaaattaaaagtgcgattttagtgtatatatgaagaagaagaaagtaaaatagttttaatgttgatatgaagaaagtttgagtggtttggatagaagattaaattagttataatatttttttaaataaaagtttaatttagggtaaagttttaattttttttaatggtatgaaggttaagagaagtgaggaagttggagaaggaaagtttgaggttagtagaggttaggttatgaagtttaaggaaagaagttatttttataatgtaaaagtgtaaggtgaagtagtaggtgttgatggagaagcggtagtaagttatttagaagatttagtttagagtattgatgaaggtggttatattaagtaatagaattttagtatagatgttttattttttattggaagaagatgttatttaggatttttatagttagaggggagaagttaatgtttgtttttaaagttttaaaggataggttgatttttatgagaggttaacgtagttgttgatcgtaagttaaagttaatatttattgatcgttttaaaaattttagggtttttaagaattttgttaaatttattttgtttatgttttagaaatggaataataggttttatttgatagtatatttgtttatagtatggtttattgaatattaaaaatttattgaggtttggtgcggtaatttacgtttgtaattttagtatttttgaaggttggggcggggggattatttgaggttaggagttcgagattagtttggttaatatggtgaaatcgtatttttattaaaaatataaaaattatttaggtatggtgttatacgtttgtaattttagttatttgggaggttgaggtaggagaatcgtttgagtttaggaggcggaggttgtagtgagtcgagatcgtgttattgtattttagtttgggtaatagagggagattttgttttaatttgaaaaaaaataaaaaaataaaaaagggttaagtacggtggtttatagttgtaattttagtattttgggaggttaaggtaggtaaattatttgagtttaggagtttaagattagtttggttaatatggtggtgaaattttatttttattaaaaatataaaaattagttaggtatggtagtgtatatttgtagttttagttatttaggaggttgaggtaggagaattatttgaatttgggaggcggaggttgcggtgagttgagatagcgttgttgtattttagtttaggtaataaagcgagattttgttttaattaaaaaataataataaaaaaaaaataaatagggttcggtgtagtggtttatgtttgtagttttaatgttttgagaggttgaggtaggtggattatttgaggttaggagttcgagattagtttggttaatatggtgaaattttgtttttataaaaaatataaaaattagttaagtatggtggtgtgtgtttgtaattttaattatttaggaggttgaggtataagaattatttgaattcgggaggtagaggttataatgagtcgagattatgttatcgtattttattttgggtgatatagcgagattttattaaaaaaaaaaaaaaattattgagatttattgtttaggaaaaaagaatttttttaaaatattattgtttattgataatgtattttgtgatttaagagttttgacggagatgtatgtaaagatgaatgttgtttttatgtttgttaatgtaatatttattttgtagtttatggagaagggataaatttgatttttaagttttattatttaagaaatatattttataaagtagtatttgttatagttagtgatttttttaatggatttgggtaaagtaaattgaaaattttttggaaaggattttttattttagatgttattaagaatatttgtgatttataagaagaggttgaaatattaatattaataggagtttggaagaagttgattttaatttttatggatgagcggtttaagattttagtagaggaagttattgtagatgtggtggaaatagtagagaattagaattagaagtggagtttggagatgggattggattgttgtaattttatgattaaatttgaatagatgaggagttgttttttatggatgagtagataaagtggtttttggagatgggatttattttaggcgaagatgttgtgaatattgttgaaatgataataaaagatttagaatattatattaatttatttgattaattcgtggttagggttgaaagaattgattttaattttgaaggaagttttattgtgggtaagatgttattaaatataatgcgtgttatagaaaaattttttatgaaagaaagagttaatttatgttaaaaattttagttaagaaattgtcggttaggtgtagtggtttacgtttgtaattttagtattttgggaggttaaggtaggtggattatttgaggttaggagtttgagattagtttggttaataaggtgaaattttgtttttattaaaaatataaaaattagttaggcgtggtggtaggtatttgtagttttagttattcgggaggttgaggtaggagaattgtttgaattcgggaggtagaggttgtagtgagttgaaatcgtgttattgtattttagtttgggtaatagagtaagattttgttttaaaaaaaaagaaaaagaaaaaagaaataaagaaattgttgttatagttatttttaatttttagtaattattatttggttagtagttattaatattgaggtagattttttattaagaaaaagattatggtttgttgaaggtttagatgattattagtattttttagtaaaaagatataatgattttatatattttaatagattatagtatagtgtaaatataattttttttttttttttttgagatggagtttcgttttgttatttagtttggagtatagtggtgtgattttagtttatcgtaatttttattttttaggttcgagtaatttttttattttagttttttaagtagttgggattataggtatgtgttattatatttagttaatttttgtatttttaatagagatgaggttttattatgttggttaggttgtttttaaatttttaattttaaatgattcgtttattttggttttttaaagggttaggattataggtatgagttattatgtttggtttaaatataatttttatatgtattgggaaattaaaaagtttgtgtgacgtgttttattgtaatatttgttttattgtcgaggtttggaagtaaattttaggtatgtttgtattacgaataattttaaatgagtaaatttaataatttatttgaaagggataaatttttttaaagtataatttattaaaagtaagataaggggaagtaaaaaaatttgaataattttttttatatattaaattgaatttgtgattaaaaataaataattattttttttagtagaaaattttaggtttagacggtttttttggtggattttattaaatatttaaggaagaaataatattaattttatgaaaatatagaaaataaagagaagggaatatttttaaattaattttatgaagttaaaatgaggttgataaagatattatcgaaataaattaataaataaagaaaatattatattaatattttttatgaattaatacgtaaaaatttttaaaaattgggtaaattaaatttagtaatatataaaaaggatgatattttataagtaagttggattttttttagaaatgtaaggttggtttaatattaaaaaattaggtttgtatagtggtttatatttgtaattttagtattttgggaggtagaggtgggagtattgtttaagtttaagaattgtagattagtttgagtaatataatgagattttatttgtataaaaaattttaaaaattaaaaattagtttggtatggtggtatgtgtttatagtttttgttatttaggaggttgaggtgggaggattgtttaagtttaggagtttaggttgtagtgagttacgatggtattattgtgttatagtttgggtaagagtgagattttgtttttttaaaaaaaaaaaaaaaaaaaacggggggtaaaaattaattattgtaatttattttattaaacgaataaaagataaaataatgattatttttatagatgtagaaaaagtatttattaaaattatatttatttatgttaaaaaattttagtaaattaagaatagaagggaatttttttaatttgataaaggttatatatgataaatttaaagttaatattataagtttggtataggtaaggatgtttattaattattattatttaatattgaattggtagttttaattagtgtaataaagtaagaaaaaaaaataaggtattaagattagaaagaagtaaaattatgtatttaaattttaaaagatttataaaattattattagagtaataaatgattttggaaaagattataggatataagatttatatataaaaatttattgtatttttatatattagtagtaaataattaaaaatgaaatttaaaatttattttagtttaaaatagtgttaaaagtaaaatttttaggaataaatttaataaatggtatgtaagattttttttttgaaaattataaaataatgtaattttgtagagatttttttttagtagagaaataaaagaaatataaaaggatttttaaaacggagatatattatttatataaaagatttaatattgttaaaatgttaatttttttttaattgatttatagatttaatataattttaattaaaatttatattgtatttttgtagatattaataagttattttttaaatttataaggaaatttaaaggatttagaatatttaaagtaatattttagatatttgagagattttatattaagatttattgtaaagttatattaattaagatgtggtattagtaaaggaatggataaaatattaagaaaatataatagtgttttaatatagggtttatatgtatatagtatatatattaatataggattatatatatagttaatataggatttatatgtatatagtatatatattaatataggattatatatatagttaatataggatttatatgtatatatgtatatatattaatataggattatatatatagttaatacggggtttatatgtatatatgtatatatattaatataggattatatatatatatatagttaatatagggtttatatgtatatatgtatatatattaatataggattatatatatagttaatatagggtttatatgtatatatgtatatatattaatataggattatatatatagttaatatagggtttatatgtatatatgtatatatattaatataggattatatatatagttaatatagggtttatatgtatatatgtatatatattaatataggattatatatatagttaatatggggtttatatgtatatatgtatatatattaatataggattatatatatagttaatatagggtttatatgtatatatgtatatatattaatataggattatatatatagttaatatagggtttatatgtatatatgtatatatattaatataagattatatatatagttaatatggggtttatatgtatatatgtatatatattaatataggattatatatatagttaatacggggtttatatgtatatatgtatatatattaatataggattatatatatagttaatatggggtttatatgtatatatgtatatatattaatataggattatatatatagttaatacggggtttatatgtatatatgtatatatattaatataggattatatatatagttaatatagggtttatatgtataaatgtatatatattaatataggattatatatatagttaatatagggtttatatgtatatatgtatatatattaatataggattatatatatagttaatatagggttgatatgtatatattaatataggattatatatatagttaatatagggttaatatgtatatacgtatatatattaatataggattatatatatagttaatatagggtttatatgtatatacgtatatatattaatatagggttatatatatagttaatgatttttagtaaaggtgttaggtaatttaatagagtaaggtatgtttttttaataaacggtgttagaattggatatgagtatagaaaaataagaattaattttgattttaaattaaatataaaaattgatttaaaatggattatataatattttgacggttataataggttaaaaaatgtaaaaatttaaaaaattaaaaaataaaaggaattatagaatatataattataaaatttttagaaaataagagaattttttttgattttagtgtaggtaaagattttttttataggttataaaaattataaatcgaaattggaaaaagttgataaattggattttatgaaaataaaatatttttgtttattaaataatattattaagaaaattaaaaggaaaggagtaatgtggaaaaaaaaatttatgatatatatatttgataaaggatttatatttagaatatataaaaaatatatgaaataatatttttttttttttttttttttgagatagagttttgttttgttatttaggttggagtgtagtggtgtaatttcggtttattgtaagtttcgttttttaggtttatattatttttttgtttcggtttttcgattatttgggattataggcgttcgttattacgttcggttaattttttgtatttttagtagagatggggttttatcgtgttagttaggatggttttgattttttgatttcgtgatttgttcgtttcggttttttaaagtgttgggattataggcgtgagttattgtgttcggttaattttttttttaaatgagatttatggggaaatagttaaatgaagaaataataaagtagtaataaaataaaatttaagttttattttattgtgtagttgtaggataaagagtagaagtttgtagttggggaataaggtgtttatttttttaagtattataaaatgaaggttttagaaattattcgattttgaaataatataattttaaaaagaagtaagacgtggatagataattttataaaggaaaatacgtaaatgattaataaggattttggaaaattgtgcgattttataagttattaagaaaatataaaataaaagttttaaaaaaaaatgaagtttggaataattgaataaatatataaaacgataataaaatgaattttgattttttattttatattatatgtaaaagttaatttataaaagttatataattttaagttttttaaaggaaaatataaatatttttgtaatttggtagggtaggtaaaggttttttataaagaatatagagagagaattataaagaaaggagtttgttaaattagattttataaaaattaaagtgatatatttttgtttattggaaaatattattaagaaaatgaataggtcgggtatggtggtttatgtttgtaaaatcggtttttggggaggtagaggtaggaggatagtttgagtttaggagttttagatttgtttgggtaatatagcgagattttgtttttgaaaaaggaaagaaaatgaataggtaagttatagattggaataaaatatttgtaaaatacgtatttgataaaagattagtatttagaagaaaaagttaagtaatttaattttaaaatgagtaatagatttgaaaagatattttataaaggaaaaatatatgaagagttaattatgaaaatgtgtttaatcgtattagttattaggttaaagtaaattaaagttataatgagatgatattattatacgtttattagaatgattaagattttatagagtgatagtattaaatgttggttaggatgtggagtaattagaattcgtatttattgttggtgggagtgtgaaatggaagggttattttgggaaaagatttggtagttttttataaaattaaatgtatatttattttatatttattttaggtgtttttatagaataaatgaacgtttatatgtatagaaaaatttgtataagaagaattagcgtaataggtttatttataagagtttttagatggaaatagttaggggttttttaataagagaatgattaaaaatttatagaatgtttatatagtggacgttatttagtaataaaatagaataaatcgttggtatttgtagtaatatgggtagttttaagaaatatttaaattggtaaaattatttcgtggtggaaaaaaagtataattgtggttgttttggggaaggtggggattgtgatgtatttggaggggtatgaggaatttattggggtgatagtgatgttttatgttttggttaggttgggatatacgtggatatttttgttaaaatttaaagaacggaacgttttatatttgtgtattttagggtatatatattttattttaaagaaaaataaaaataattatagataaatgtcggattttagttaatgaaatgtaaattgaggtgttgataggatgttgtgtgttgatttttgtagtttattttaagtgtattaaaattagcgtggatgttggtggttagagggatttgtggtgaagtaaatagtaaaatggttgttgtggaatttaggtggtaggtgtatgggtgtttattttagaattttttatggttttttttttgtggttttgttttgttttgtttttgagatagggttttgttttgtcgtttaggttggagtgtattggtataattttagtttattgtagttttaattttttaggtttaagtaatttttttattttaatttttcgagtagttgggattttaagtttgtattattatgtttgattaattttttgtattttttatagagatgggattttattatattgttcgggttggttttgaatttttgggtttaagtgatttttttattttaattttttaaagtgttgggattatagttatgagttattatatttagtttttttttattttttttatgtttgaaaagttttacggtaaaaagttggaaaaatgtaaaaaagattgaaatttattaattaaaaataggaaaaataaaataaaagagatggtaggagattattttttttttttttaatttagtttttaatttttttttttttcgtttagttaggataggaattttaagggttcgggtttttcgtgtttgtgcggggaaggaggtattttcgtgtttgtgcgggggttggttatttgtttttcggtgtattttttgtattttattttttttcgttcgtagtgagtagttatagttggcggaaattatatttaggtagtttttgtttataaatttagtgaaaatgtaaatttcgtaggagttggattttcgagagtttgcggcgttatttgttggaggaaaggttttttgtattcgagttttttttttttttttcgttgttattcgtttttttgtttaggttgggcgggttttttttttgtaatttcggggtattggtgtacgggaaatgtttagtgttttataatttttttttatttatattttaatatttagtttttagtggatatcgttttcgttcgataaatatattatataggtatagtttaagattatttattttaggaggagtataagttttagtgtttattattttagtttttttttttttttttttgacgtagtgatataggtttaggatattgaagatttttgattttataaatatgttgaagttaattattttgaagttgtagtttttattattattattattttttattttttgtaaagataaagttttgttatgttgtttagtttggtttggaatttttggatttaattgatttttttgtttcggttttttaaagttttgggattgtaggtgtgagttattgtatttagtttgaagtcgtagttttttaattattgttaatagtaatatttatttttttgtgagtagtagggtttgttggtatggttgatagttttgtattattgtatcgaatttgttgtttgggattttaggtgagtttcgatttttagttggagggataagttgtgtggggttgggtagggtgaattgcgggagattaagtttagattgagggttataagttatatgagtattggggttaggtagggatagtgaaggagatagtgtaattttgaggaaagataacgttatagaatggagaggtttaggttcggggtttttttttgttgtcggataggtatgtttgtgttttttttttagttttcgtgatggttaagttatgtgttttttgagaggtaagcgaggtttttgatagtaggttttaggttttaattaaattgtttgttttgtagggtgagttgtataggtgtttttattttcgatttttttgaatttttgttgtttttaagttttatttattttttttaggtgaatagaaatattgtttaggggagaacggaggaagaatttaggaaaggttgttcgagagtttggttgagtttacgttatcgttaagagtagcgttaaaatttaggagttggtgagattatggtttagggtttatattaatatgagggggtgttagttttatgattaatgagtttttgttttattattttttgttatttatattttgagggttatagttagtacgtgaattggagttggttttcggtatttttttttttatattagttttataatgtgaggtgggggttcgtttttagaggtattcggagtagtaggtgttttaagagggggaagttttttcgaagtttttttttatttacggtataggacgtagaggggatagagtattaggaatatttagcgattataggggtttgtttcgaaggagaggaggtaggaggtagggagagtggttgggaggttagttttggagtgtttattttttatttcgagggagaggaaggaagtagaaggtgagtatagggagttttagttggggatggagcgggggttgtagttcgattgtgttgtttggagcgggggtatggattgtagtttttatttatttgtttggttagttcgaagttattttaagtttggagattttatttgttttgtttattttttttagggatggtgtttaaatttcgaagttttggttggtgttgtaaatatgggagggaggttttgttttattttagttttaagagttagttaagaatgttttggatatttgaattttgtttcgagttagaggttgggaagaaatttgaaggatggtgggacggtggatagtagtttttaggtattaggtattagggtttttgtttggggatgggggtattagtaggtgttaagtgtattatattagggtttattatgtttttgtttagagatttagtattttacgaaataggaaggaacgagggatgagcgtgtttttttttttaatattttagtttttgttttgaggttgttaggtatttaatttttttaggatttaaattattttggttttatttacggttaagtgtattaaattatagttaggattattgggtttagatattaaaagcgttttttttaaagtcggtagttattagggtagtatagggtagtgtaaggttgggtagggtcggttatttgttagtatttagtggtttttgttggatgttgacgggggtagttaggtaggtgggtttatttagtaattaaagagattttttttttttaattttttttttaaagagattttgattttttttttttagttgtagggtttgtagtagttttttttttagtaggtttttttgtttgtttttggttatttttagtagttatagggtattgaggttttattatagtgagaataaaattaagtttttattagggtttttaaggttcggtacgatttggttttgtttgtcgtattggtgttattatggttcgtttttgaaaatatattttagttatttttattttttttaggttttagtttcgggtttttatatttgttgttttttttgttaggttgttttttttttggattttggtttggttgggtttttttggttattatagttttagtttagtgttattatttagaaagggtttttattaattttttcgttatatatatagatatgtatttttagtaatttgtttttagtttttttatagtttttatttaaaattatttatggatttgtttatttgtggattgttttttagttttaattgttaagtaataagcgattagcgattgtgtttttgttgttttttattataggttaagtatttaagagaggggttgtatatagtaggttttaataaatatttattagacgggttaggtacggtggtttatgtttgtaattttagtattttgggaggttaagttgggtggattatttgaggttaggagatcgggattagtttgattaatatggtgaaattttatttttattaaaaatataaaaattaattaggtatggtggcggacgtttgttattttagttatttgggaggttgaggtaggagaatcgtttgaatttgggaggcggaggttgtagtgaggcgagatggcgttattgtattttagtttgggtgacggagtgagatttcgtattaaataataataataaaatatttgttagaagaattaaagtagtttgtttgtgtttaataggaatttaagagtataagatgaatttaattaaaggatatatatagtaggtattttatagttgatatttgttggtggagggagattaggaaagtggggagaggtagtgtttgggtatggggatattttgggtatggggacgttttggatatagggatatattgggtacggggatattttgggtataggacgttttgggaacggggatattttgggtacggggatattttgggtatggggatgttttggatatagggatattttgggtacggggaaattttgggtatggggatgttttggatatagggatatattaggtacggggatattttgggtatggggatgttttggatatagggatatattgggtacggggaaattttgagtatcgggatgttttaggtacggggacgttttttgttatttgaaatttcgtagttttattatattcgtttgttttagtaaatcggtttaaagagtatttttaagtttttatggtaaagttttagagttagtgttttttcgttgatttcgagggtgtgttgtttatttagtgtttaagttagagtttttttatttagaaaaaaaaagaggagggtggttttacggatggaggtatgagggcgtttataggtagagggagttttcgggttgagatttgcgttattttttgttttaattttaaggcgtagtttggagtttaaattagtttttaaacgtgggtcgttggttaagaggaatttttttatttacgatttttttttatatttagtttttattgtttagagtatgttagttttgtttgttttggtttttaggatttttttagggatttttaggttttaagttagggtgggtttgaattaaggtagttttagaatttatgttaatgtttttgttagtgggagattttggggagtatcgtgcgggatgtatggggttaggcgggggtatatagcgagcggttttagaagttttggtcgttcggagtgggggggtgtttagagtaagagacgggttaggaagttggagtgagtaaggaggttttagtttttggtgggagtaggtcgggtaaaaataaattaatttgagggtagtagttagcgagattattataggaggggtggtggggtcggaggggttttaggagtttaggagagggaggtattgttagaggtaaggtcggtagatgagagttagtgttggtaggattaatttgttatagtagttatggtttattttttttttttttttttatatatgtttttggggtttatggaatttattagtttattataaaggatattataaaggatataggggaagagatgtgtagggtaaggtatgggggagggacgtagagtttttatgtgttttttaggcgttttattttttaggagtttttatatgtttatttatttagaagttttcggaattttatttttttgagtgtttacggaggttttattacgaaggtatgattgatttaattattggtcgttgatgatttgtttaatttttagttttttttttttatttggaggttgcggggtggtgttgaattttgtgattttatttggttttttttgggaattattttgaagttgttagttggtttgttaattatgagtatttaaaaagatattattttggagattttaaggattttaggagttgtgtgttaggaaatggagatgaaaattaagtgtatattttataatatgatagttagttttttttaattttagttttattttttgtcgtgttgtcggttttagtttttcgcgttttagggtttttgaatatattgtcggttgtttgtagcgatcgtttttgtttgttgggtttgagtttggtttattttttttatttttttgcgtttagttcgaaggtgttttttcgaggtagtttttttgatttggttttacgaatcgtaggttttgttttgttattggttttttttgttatatttgttattttttgtgttttacgtttattgatgtggttttgtatttgtgtagttttatgagggtaaggattgtgtttggttttgttttttacgggattttagcgttaagtttatagggagtatttaatgttgaatgaatgaatgagtgatcggtaagggaggtttattttgttatgttgggggttaaaggttgttgggcggattatatgggtgaggttgggtggggagggaagtagagatgattttttggaagaaggggtaggaggcggggaggtgggtgtggggtgttgtataaggatggtaagtgtttttaggggtgataagttaatttagagtattaggtagtagaaaaaggttgatatttttacgttttatttttatttagggagaggttaggttttcgggaaagttagtttttcgttgttaggagagttttaagggaagttttattagttgttgagttggttatagtggaaatttatgtggtgggtgggaggggtttgaggtataggggtttgggtggtggttttaggatggagatttgtgtttagattatgaggggtggttttagggatgattatttttaaataggaagtagataaaggtatagatggtagaagcggaggtagagaatgggttgtaggggtttttttagagggagagtcgagtaaggggataggttggaaatatttagtttttatggtttgaagtatagatagttggttttatacgtaggtcgggtagttatattatttagaataaggggtatgttcgtagggtaggttttaggacgtttcgggttggttttgttattagtttagaaagacggtttaggttttttcggtagggagtacgtttagttaggttttgggtaggagttgagattttttggttggtttgagaggggatgatcgagtgtaggtttagttcgggatttttttattttttttcgttatttagcggaattagttgggcgtgagaaaagaagagaagtgaattaagagtttagagtatgaggttggattagtttttatattatatgtaaaaattaatttaatttgtattaaagatttaaatttaagagttaaaattataaaatttttagaagaaaatataggggaaaagttttttgacgttgtatttggtaatgattttttggatatggcgttaaaagtataggtaatagaagaataaatagataaagtggaacgttatagaagtttaaaatatttgtatattagtttgggtgcggtgatttacgtttgtaatttcggtattttgggaggtcgagacgggtggattatttgaggttaggagttcgagattaatttagttaatatagtgaaatttcgtttttattaaaaatataaaaattagttgggtgtggtggcgggtgtttgtaattttaattatttaggaggttgaggtaggaaaatcgttggaattagggaggcggaggttgtagtgagttaagattatgttattgtattttagtttgggtaatagagttagattttattttaaaaaaaaaaaaaaaaattgtatattaaagggtattaataacgtggggagaaggtaatttatggaatggtagtaaattataggttagatatgggattagtatttggatattaatttatagattttttaatatttagtaataataattatttaaattaaatataggtaaaggatttggatagatatttttgtaagaatatgtgtaaatgagtaataaatacgaaaagatgtttaatattattaattattggggaattgtaaattaaaattataaggagagattttttataattatgagttttgggtaggtaggaagacgtttggtggggagttgtcggttttatgttgtttttagaatttttgtaggggttaagttcgatttcgatattttattaggagtatagaaacgagtggaaaaggttaaaggttattttaaagggttagaggggtttagtaaggagtttgggatatggaattatgttgtgtatttagatatacggggataatagggggatgaaaggtggtttttaaaatttatatttattttagagtttatgaatatggtttatttggaaaaagggtttttgtagacgttatgaagttaaggattttgagatgggattattttgggttatttagtgggttttaaattcgagaaagattgttcgtatgagagatagatagggggagatttagggtatagaaggaggtttcgtgataacggaggtagaggtcgagtggtgtggttacgagttaaggaacgttaagggtttcgggagtcgttagaagttgttagaggcgagaagtaggttttttttcggagttttcggaaagaattaggtttgttgatgtcgtgatttcggatttttggtttttagaacggcgagagaagaaatgtttggtgttttgagttatttagtttgtggtatttggtgatggtagttttaggaaattattatagggattagagtttttacggggttgggtaggaagcgggtgtagagcgcgttaggttaggttttttatttcggagatggaaaagtagagttggagaggttgagatcggataggtatcgagcgtttaggggtaagaatttttaggggatggtagaggttatcggggatagtatagcgagggataggagggaggggtgagggttgaggtatcgttttttaggaggtttcggtttttcgtttattgatgatttaggaatttcgtaagaggagttgggttttattttgtgtcgtattgtattagatggattttggtggggatagacgtttagcgatagcgtggttaagttttttttaggatttcgggtttgtatttatgattatgtatagacggttattttttttgtttgtagttttttttcgtggtttgtttttagttttttagtttaatagagttttttagtggaaagttttttttttggagattttttttttgttgaaatataagtttttggaataagataaaattgtttaatttgtaaaagttataaagtcgttttagaataaaaaaaaagtttcgatttttggttggaaggagtggttttttatgttttagcggttagttattattttatgatttatgtcggttttgttgataaattttttagtatttttttaggggaaggttatagtttttagggagggcgggagagtatttaggttttcgtttataaattagatcggagttagatattgtcgagggagggataagagggtaggttttggggtttttaagttttttttggggttggtagattatcgtggatttattagggtaggattatttttttttataaattttttttgggtagttgtagggtagtttgagttggatacgttttatacgttagtttagtggggtatgaggtatttatagttacgtttggaagttagcgggtcggtatttgtcgggtaggtttttgttatataggtatagcgttttttttatggtttttttttaggttagagtatgtttggggattagagtagttttcgtagtggtttgtagtttgataacgcggcgtgagttatgttttgtagagaagaagagttttttagtgagggaagaggcgtttataaaatttaggatacgcgtagaaattcgtaggaggtgggggcgttgtttaggggtcgtgtcgtttttattttttattttgtagatgacggaattgcggtttagagttgttaagtggtttgtttaaggttatttagtagggataggaaggaagttatttttttagggattgtgcgggagtttagtgataattaaagattagcgttaaagtttgtttaggacgagaattttattaagggaaatagtttcgggattgtcgtgtttattcggaaggtagttagtttataattgagtttttaaaaatgtacgtttttttatatgaaaatatattcgaatgggattttgtagaaagtattttttattaaggtatagttcgaggggaggttttcgttttatttttggttgtgttgtttttagttaagggtagtagggattagagtggtttttggggtatagtattggttgtttttaaagagtgttttgtttagtttatgaaaagttcgtgttttgtgagtttgggagggtgttattatttttagttttttagggagtattatttttaaatttacgtttttttgtttagtttttagattttttgttggttatttatttgggtttcggttagattatttataaagtgaaggtcgaattcgaggtttttcgaggtttttgttagttaggcgggtggagtgacgtttttttggggttggtggtttaggaggtaggggatttattgtggtttgtttaggttgtttggtggggtggttatttcgaggacggttttattgtgtaagtttgacgaaggttttttttagcgttttttgttttgcggtttttgttgggcggagagtaggacgttgggttttatatttattcgttttagcgggtttgagttttcgagtttaaatagataagatgtagttttattgttatttaagttttttgtcgttttttttggtttttttttgaggttcgtttgttgtgttcgattgggtgtgtttagcggtataatatatattcgttttattagttttaacgtgataattaagatgtggttttgaggtcgggcgtcgtggtttacgtttgtaattttagtattttgggaggttgaggcgggcggattacgagattaggagatcgagattattttggttgatacggtgaaattttatttttattaaaaatataaaaaaatatggcgggcgtttatagttttagttgtttgggaggttgaggtaggagaatggtatgaattagggaggcggagtttgtagtgagttgagatcgcgttattgtattttagtttgggtaatagagttagatttcgttttaaagaaaaaaaaaaaaaaagatgtggttttgggagtagtggtggaggggattatacgttttagagaggagttatcgagatgggttttttttttttaggttttttagggattttttaatatatatatagtggtaattaatagattagggtttaaggtacgtaggggttgatatttttagcgatttttcgttttatggttcgtaggttattttagaatatttaaagtttggagtttggtttagttattttatgttttttagcgttgggtttagagggcggtatgagcggtagaaattgttattattgttaattatcgatgacggcgttggttacgtgagatggtagttacggtatcgtatgtgagtgaagggattaaggaggttgggtttgggagggagggtttggaaagttggggtgaattaaaggtaggggagttttttttttttttatttgtttgtttacgttttgatgggtttgtgtttgcggtaagggggttgttagcgtgaatggatatacgtatatatatgtatatatacgtgtatatatacgttaggtttttttgagcgtcgggagtttttttttttataattaattgttaggaaggtatagaaatgttattttaggtaggagatcgaggtagttttgaagatagattttggttggaagtaaaaaataaattatatagtggataaattaattattagttaggtttaagcgtcgtcgttttagattcgagttaggggggtaggttttttatatttttttaaggtttcggcgttaatagttttagtattgatagtggttatgatatgtaagaatggtatattggaaaatgaaagggaagtagttaggagagaggagagtcgagtttaaataaaagttagatttaggagagtttagtttttgagacggagtttattttacgagtttggaatcgttaaaaagaaaagaaatatttttgtgaaaaatgagtaaaagcgttttttgtatgtttatttttttaggtataaataaagtttcgagtttagggtagtggggggcggtcgatggggagggggttgtttgcgtatttgagattcggtttttttttatttttacggatatatttagtagcggcgggagtttcggcgtttcgtttagaggcggtttttttttttttattttcgtcgtttttttttttttagttttttttttttttttttttttttttaaaaatattttttgtttggtttaatttttttaatttgttgtaattacgaatgtattcgaattattatatttttatgtgttgattatatgtttgtgttttaaattgaagtagtattgtttttttaaaacgggaggaaaaagggagtaaaggagagaaatttaaaaataggaggtaggagagagggttcgaagtgggtttcgaggagttcggtagattatcgggtttgtttgcgagagttttagagtttcggtcgttcggtttggtcggtggttgtagaggtttcgagtgcggttttcggtagttttttttttttattttttttagttttcgtcgtttcgaggtttgttgtttttttttaatatttatttggagatgtttaatttagatttttggaaattaatttatagagttaaatttttgacgatttttaaagttttttattttttttgtttcgcgatgttacgatttttttgggtttaagggtttaaaaagtttagtttttgcgtgtttgtttcgtttttttttgttttgggttggttttagtttttttttattttgtattttaacgtggttgggtaggaggaacggtcgtgttttaggttagcgtgttgagaaaaggtttcggagtatttgtttaggaggaattttgagaagttattttttttcgttttattagtttgtagtgatagaggtagttgtcgttttcgtttaggtagagagggcgaacgggacggggattttttggaagatttttattatatacgtatgagttagtgagtttttagtcgttttttgggagggagcgagttttttttttcgggaattcggggttttattgggggattagtgttgttttttattgtttattcggggtttttagaggttgtttatttatttggggggtttttattagtatatggttagggtttatgttgaggttaagggtttagtagagtaggtgggggtttataatgtgggtttttggggtgggaattaggggtattttttttgtttttaagttttattttaagggtttatttaaattcgagatacggaggttggttttgttggtttaagtttgtttaaagagaatgtgtgtttgtgttaaggttgagaatttaggtaatttttttgaaaattttagattgttagtttttgttgagaaagggaggacgcgtggtcgtattacggaagtttttttgtttggtcgtatagggttggtataagatagttttgttttttagataaaatattttttagtttgtgttgttttttaaggtttttaataaatttataatatttgtatttttttatttcgatatatttcgtaggtttttgagtttataatttttgttttatagagttaggtgagttatttgtgattaggtgaggtttatgtatagttttcggttagatgatagagttaaaggttttgaagtgttattttaggttatagtttcgttcgttttttgtttgggataggattttaaatgtaatttttttggtagaaaggatatttttttggggggtggggaggattatttttagttttttgggagatattaagtaattatttttttttaaagagtttggaggatagttttataggtagttagatagtgagggaggtggggatagtattttagtcgaggtgggaggttggggaggaagggagggattatagttacgagagaaggttgaataatggttttagggatagtatgttttaatttttagatttgtaaatgggattttgtttggaataagagtttttgtatttgtgatttagttgtagattttgttgtggcgagagtattttggatggtttaggtggtttttaaaggtagtttcggtgtttatataagacgggggtagagggagatttgatatagatagggatggttaagtggagatggggttcggagagatttgtagatgttggtgttgaaggtaagggttatgtagttataagttaagggatatttatagttattagaggtttaaaggggtaggcgatgaaggtagtggtttttaatttttttggtatttgggatcggttttagggaagataatttttttatagattagggagtggggagatggttttgagatgatttaagtgtattatatttattattttattttattttattttattgagatagagtttcgttttgttatttaggttggagtatagtggtattattttagtttattgtaattttcgttatttgggtttaagtaatttttttgttttagttttttaagaagttgggattatagacgtttgttatcgtgttcggttaatttttgtatttttagtagaaacggggttttattatattggttaggttgattttgaatttttgatttcgtgattcgttagttttggttttttaaagtgttgggattataggtataagttattgtgtttggtttttattttttattttttgagatagagttttattttgggattataggtgtgagttattgtattcggttataagtacgttgtattgattgtgtattttatttttattattattataatatataatgagataattatataatttattataatgtagaattagttggagttttgagtttatttttttgtaattagacggttttatttggtggtgatgggagacggtgatagattattaggtattagatttttataagaagtacgtaatttagattttttatatgtgtcgtttataatacggtttatttttttataagaatttaatgttatggttgattagataggaggtagagtttgggtagtaatgcgagtaatggggagtgattgtaaatatagatgaagtttcgttcgtttgttagttatttattttttgttgtgtaggttagtttttaataggatatacggggttgggaatttttgttttagagtttttagagggttatgtttagtggatattttgattttagtttggtgattttgatttcggatgtgtggtttgtagagttgtgagaggatggttgggcgttgttgtgatttagttagtttgtggttattcgttatagtagttgtaggaaattgatgtagcgttatagacggagttagggtttagtttattggagttgttttttgttattttatttttttttaaaatattgtgttaagttaattattaataattattgatttcgatgggtaggaatcgtagaggttttttggtttgtttttttaattttttttttaattttgaaataatattttttgttggtttttttgattataaatgtaatatttttttttgtattgagtttagaaataagagaaaaagtaaaaagtagaaattttagttgggtaaggtggtacgtgtttgtaattttagtattttgggaggttgcggcggaaggattgtttgaagttaggagttcgaggttgttgtgagttataattgtattattgtattttggttgggtaaaaagagtgagattttgttttaaattaaaaaaaaaaaaaaagaagaggaagaaaatttattaattttattcgagattttttatacgaatttttgttgtggggtagggaagtttaggaaggttttacgaggttttgatttagtttggttggcggtgggaatttgggaatagtttcgagtgaggggtcgggttatgattgagtttatttatttagttattttttgtacgttgtgtatattatgggtttgacggttagggttggagtatttgttgagtatagttttgatttttagttttatttagtatggtttggtttgaggtttatttttttttcgtgtttgaaaatttaaatattttggtttaggcgggggattatttgaaatggaaaatttggtagtatcgattggttttgaagaggtaggagttagttatgagtcggttgggaggcgagtgtagaggtggtgaggtaaggttagtagagggtgggggaggcgagggttaattttttatcgcgtatggtgtaagtattaagggggtattttattaggttagtgtagatttaggtttttgcggtggatttttcgcggtttttttttttagaggaatattgaagaggtttttgtggttttgttttagatttagaggtatatttgtatattaaacgtattgagtaattttatagtgagggagtcgggtttggtttaatttatttttttttaaattggattaaaggttgttgttttaggaaggtagggtttttaggtttacggttttgggaaattttggttgtgttagtttatgagtttagtttttagttattttagtttgtttatattttggagtgggtattgttatttaaaagttttttttagatagtttttagggcggtatttttgttttttattttttatagatttttggttatttttttgcgatattagtattattggtttatagttttttttaattgtaaagtggggtttagcggtataggttgggtttggtagggcgggaaggaagagcgaaggttattttgtttttaatagtattggtcgggttttggaaaggtcggaatttatagataggaaggaagtgttatatttatttaatttgttttgcgttagttagggggtattttgtagaaagaagttaggtggtcgtggtcgggtgtagtggtttatgtttgtaattttagtattttgggaggtcgaggtaggtggattataaggttaggggttttagattagtttgattaatatggtgaaatttcgtttttattaaaaatataaaaattagttgggtatggtggcgtatgtttgtaattttagttatttagaaggttgaggtaggagaattgtttgaatttgggaggtggaggttgtagtgagtttagattacgttattgtattttagtttgggcgatagcgcgagattttattttaaaaaaaaaaaaaagaagttaggtggttattttttagtttttggtttggtttaggaattgttttttttttaagatgttattaaatgttttttttattaggaagttttttttggttgttttttttatttttgtttttgttttagaatacggttcggtttttacggataattttgatattagagtttaatagagatttttttttttatggaaatttatattttaaattgaatatgtgtgtaggataagtttttgtttttatgtgaaataaaagtgaaaggtgcggattatttgtttttttttatttttttttataataatttgggttttataggggtttagtaggagttaggtttagtttagtcgttttaggtgtattattttgggtattagcgtttttgtttttttttacgaagtatagttttattttttggtatttagtggggaggggatatatattaggtattttttagggtggattgtgttttttatattaggttaggaggttttggggttggtttagttatttagaaaagggagtaggcggtttaggtgatattgatgtgggtagtaggggttttcgggaaagggttttcgtaggatcggttttattttgttttaggagtatatattggggaagggtgttgcgcggaggtggagagaacgtatttttggttgaaagtatgttttttgatgttttgggttcggatttgttgttattttttatgtttttttatttaatatacgttttagtaaattttttatgttgatgagcgttaagttatagaggacgtataatttttcgttttaaaaagtgattttttttgttgggtgtggtggtttatatttgtaattttaatattttgggaggttaaagtgggaggattatttgaggttaagagtttaagattagtttgggtaatatagagaaattttatttttataaaaaaaaaaaaaaaaaaaaaaagtttaggtatagtggtttatgtttgtaattttagttatttgggaggttgaggtaggagaattatttgaatttgggaggtagagattgtagtgagttaagattatgttattgtattttagtttgggtaatagagtaagattttattttaaaaaaaaaaaaaatttttttttttgaaatagggttttattttttttgtttaggttggaggatagtgacgtgattataatttattgtagttttagtttttcgggtagttggaattatagggttgtattattacgtttagttaattttttgtatttttagttaagacggggtttcgttatgttgtttaggttggtttggagtatttgagtttaagtgatttttttatttcggttttaaaagtattgggattataggtatgggttattatgtttagtttgaaaatattttttttaagaattagttagttatggtggcgtataattgtagttttagttatttaggaggttaaggtaggaggattttttgagtttggtaggttgaggttgtagtgagttataattgtgttattgtattttagtttgggggatagagaaagattttgtttagaaagaaaaaagaaaaaaaaaagatttttttatttattttttgtttatttttagatttaattattgaagtttgtttttttgaattaaaaatgaaggagtttcgttttggatttttttttgttgattttgttattgtatttgttagtagagttagttaagattttttaggttggttttagtttggttcgtttatagttttttaagtaagacggatttttaggttgaggttagttgtatttttttttggaatttttttttattttttattgtgttttagattttggttgtttttaaataaatataatttagttatttttgtttttggggtcgttgtagggtttattggtgtaaatcgtttgggtaggtttgttgttttaggagtttttttaggttagcgtggaaggaaattaagataacggggagaagtagttcggttgggtttaattttatttttatatgttcgtgtttagttaattatttgggttgtagtttgataggagttggagttggcgttttatttttagagggggttttcgattgtttttgtagagcgagggaggtttgggggtgtagaggttaagggtttttgtagagtttgttttaggttttttgagtttaagtttttttgtagttaacggaagattttttcgagagcgggtgttttttattttgtttgtttagtaggtgtttagtaatcgtttattggataaataatgaatttgtggatttaacgtgaagatgatttaaattagcgtttttttatagaatttttcgtaatgatgttaatgttttgtatttgtcgtagttaatatggtagttatatgtggtagtgaacgtttgtaatgtggaagggttattaaggtaaagagtttcgtatttatgttataatttaaatttaaatagttataaatgtttagcgtgtgtttcgttatatagattttttttgttattttttttttttttttagagatattgtattcgttattaattttttattcgggaggtaaacggagaaatgttattttttagttaacgtaaaagaaggttaatatttgtattttaagttagttttttgggtaatttttttaagtattttttattaaggttagtttagtaatattttttgattgtttgttacgtattaggaaagtatttcgtcgtggttttggttcgaggttatggaggatatagaaataattaaggttaagttgatagaaggggtgtgataagatggtttaaagttattgagttagttaggaggtttaggagtatggaagttttgttttttagaggataagtggtaatttatttagggggggttcgagtatttagagttaggagcgtagaagtagggggttttaggttggaaagcggtattagggttaggttgggcggtagtacgaatttattttcgaggttttgggggcggaaattaagggttttatgagtaagaagattcggtttaggtttaatggaaatgatcgggtggagggattttattattcggtttttagtatatagggagggaagtggtaatcgttttttaaatgttggtcgtggaggggaaggagttatagtagggtaggggtggggaggatggtatttgttggtttaaggagggatgatggaggtttaattaagatatgatcgtgatcggggtagtttgtttaagggttagtatgtagagggcgagttgatgagattttggtagtttgttgagatttgggggtgttggggaggtagaggttaaggttaattttgagattttttgtttgtaaatttgggtgggtggtaaggttgatattagagaaatagaggaagagtgggtagttatgggtgagagaggaagtaatgaattaggggtgtttgtaagagtttaggggtaaggttttcgggtagttaagatgttggtggttttttttacgattagttttttttacgtggtatatttttgtttgtatggttgggtatggggtatttgttcgttcgatatattttgagtagttattttgtgtattgaggtaacgtggtacggtgttttggggaaatagcgaggaggtattgtataggttttatttttttggtattttttgttttttggggatggtggtagttaaataagtgatagttaattgttaggagagtttggttttgatttattaggtggagttaggtatttttgtcggaagaggtatgggaattagtataggatgaagggaggtagcgagtattagtttaggttttgtttttatagggttttttttttatatttatttgtgtaggcgttttttgtgagggtagagatatttgtagtgtttgagggagattttttgcgggcggggtcgtttatttatagcggttaggtgggaggtgtattagtgttttgtggttgttataatggattatagttgtggggtttgaaaaaatggaagcgggtttttttttatgttggaggttagaggtttaaaattaaggtgttagtaaggttatattttttagggaggttttggggtggggtggggggggggtttttttttgtttttttttagacgttttttggtttggggttgcgttattttattatttgtttttgtttttacgtggtttttttcggtgtgtttgtggtttttttgttttttttaaggatattagttgttggatttagggtttattttaatttagaatgattttattttaagatttttaattatttatatttgtaaagattttatttttaatttttaggttatattttgaggtttttggtggatatgagtttgtgggggatacggtttaatttaggatagaagggatgatgggggtattggggaaaaggttatatattttagaggtattggaagatggaagagtaggatttagcgatacgggatgttaggtagaggagttggttttaaggattttagtcggggtttgagggttagagggagggaagtttaggtattattgagatgaaatgtttcgtgtatcgtgggaaatagggtaaaagttcgttggacgtttagttagagaggcggttgtttgaggtatagaaaatgagcgaatatgggagagtttattagaaggttattcgggagggcgtggtggtaatatttagaagggttgagaagcgtatttttatagtttagttaaatttatttggggaaatatacgttttcggtagtattagtaatagagaagattttcggcgatgttattagtgggttacgggacgggtaaattttgtttttttatatagaggaatattcgttagttgttaaaataagtgaattaaggtttcgtggatttatacggataagtttttacgtcgttacgttgtgggtataggtagggtagttattgattttagtgaggtattaaggatgtgatgttgatgacggtatttaagaggagatagatttaggttgtttagttatacgatgttgatgatcgtatgtaagaggagattaggtcggatgcggtggtttatatttataattttagtattttgggaggttaaggtaggtggattatttgaggttaggggtatgagattagtttgattaatatggtgaaattttgtgtttattaaaaatataaaaaaaattagttagatatggtggcgggtgtttgtaattttggttattgaggaggttgaggtagaagaatcgtttgaatttaggaggtagaggttgtagtgagtcgagatggtgttattgtattttagtttgggcgatagagcgagattttattttaaaaaaaaaaaaaaggagatttaggttttttagatatattattgtttagtatagatgtgtttgttcggggttagattttaatttagaggggcgggtatcgtagtaggagtggggttaggatggagaaggttatttagggttgcggttatatttgtaatgttttattttttaagcgggatggtgagtatataggtgttttattattttattttttatatttttgttttgtagttttaagaattttattttttttttaaaaggaaagaaagtgtgtgagttgattaaagcgttgattatggtgttatttaagtttttgttagaaatgttatttttggtttagttttaaatataatttcgagaagagttttcgtttttttggggagggtaagagttttagatataggagattggttagatgtggatttatagagaagttgggttgggaggatgggatggtagatagtcgtttggggagtgttaaatggggaggtcggagatgttggggcgtttaggaatgaatttttgtttggattagggttttagtaaaagggaggtagggagaaagaaagaagttaagaagatgaggaaagggtgtttcgggttagagtttatagaggtttatagagggaggatttcgtgtgttagtaggtagttttacgtaaatttagattattagtttgtagttttgggatttagtaaattatgttttaggtttttaagttgagttgtgatcgtggttgttaagtgttgatagtatagaattagttagtttgagtagagggaagtaatcgtcgggggaggttgtgtttatgtagtttagggtgttaggtttttaagatgtaatttttataagaattgggggattttttttatttattttattagaagttggttaatgagagggaaggagatggagaggtagattagatgcggagtcggagaaaagttttttagaaatatagtagcggttgggttgtttagtggttagtgtttaatatgattgcgatgggcggagttttttttaattatagcgttgaattatgtagttgtttaggggtttttagttagagtattatttttttttttttatatatagttttattttgtattgtaaggggttttatatgtatttaatgtggatacggtattttttttatttttattttttgtaaaaagttattttttttattgtttaggtttggtggtgtatagtttacgggtattgtatttatttttggaaggtagatttaggaggcgtttgtgttgtttttatagaagtaagtttaggattagaagtaggttttgggtttagaattttgaggttttaggtgttagtgtggtttggaattgtttagttttatagttattagttatacgtagatataagtggaaatttatttaaaataaataaataattttatgtaagtaaatgagtgaataaagtaaacgtaaatatttatattttgagtgtgtaatagatttaggcggttaagcggttattatataggatggcggagtgtagatgtatagaatagatttattattatagaaggttttattagacggagttggtttagagtatggaggtggcggttttagatgggtatatgtttttgttttcgtaggcgttttgttttggtaggacggttgttttattttgttttgaaggtagttttggtttataggcgttttatttgtgtggatttgatttcgggttcgtgttttttggtaattttgttttttttagaatggttaatttatgaaggtatagtttttgtttgtttgttattatgatggtagttaggggtttggtatttagttggtttttagtatatatgtataggtgattacgttatttttgttttttttagagtttttcgttttttaggggaggtaagtttatttattgttgtgatttattattttttttaaatagaaaagttattagatgggtatttgttttagtttggtcgttggaagtgatagttaagaataacgtaggtttttagaaatagaggtattagtatggttatattggggttaggtaggggagattagggatatttagtggggagaagatgacgcgtagatttagttttggggggtaagggttggaggtagagttttgatttttttgttttatttttttgtttaggttgtatttagtgttggtagagtttttttaagtttataagttgtaattcgtgttttggacggttagttttagagttttgatgggtgtatttgttttttttttttattggttagtgtggaaaatttttaaatatatggaaaaagtataaggagtagtatagtgattattgttagaggtttatttatttttttttagataatatcggacgtatttgttttattttggagtattttttattttgtaaggttgtagggagtttatagatattgaattaatatcgagaggtttacggttaaagttatttgtttatggtatatttgtttttttagtattttaaattaaattatttagttttatttattttttgtttttttttttgtttcgtatatacgggtttgttttttgagtttgggggtggttgtttttgtttttataaggattatttttagtagggtagcgtcgataggtttggaagttatttgagtttaaagtcgttaaagattgcgtttttttgggaaatgggtaagtggttttatttatttagggaagttaggtggggaggtaggttttagattagaatgaagggattttagtataaatatatttatgagttgggtggggttagagcggagcgagttatttatttgggttattggagttattaagttttcggagtcggttattggaggttcgcgtgttttttaaagatagagataaagggtaaaggttatataaggttattggcgtttttttttcgggtggatgattaatattaggaatgttttcgtttttgtttttgttgtgagttttagagttagaaacggggtttatttggggatagaggttttatttttttaggtaattttggacgttggagggatgatagttattgttgtttggttgttggaggggttttgggttaaatttttatatatatttttttttaagttttattatttttgttttgtagataaggaatttgagtttttatagagtgttatttttttgtggttatatagtgaatgagagttgtatataggtgagtttacgtttattagattttaagttgggttgtatttaagcgtgtttttgttggacggagtttttttttttttttatgtttattcgttttatgaattagggtttttttatattagggtttataatttacgggtagttttgatttagttttttttatttttagggttgggtgtagtcgggttggatttggggatggagtgggataggttatttttattttttgttttaggagggaataaaaatagaattttagattaatgtagtttttcgcggtatgcgttttttttgtttatatataggttttggtttggggttgtttgttggagaggtttatggtaggtaagttttaattcgaggagatttgttgaggtgttaagttaagtaaattcgaaaggttgttaggaggagcggttttgggagtataggcggttattttattgttgtagagtacggtattttggggatgttttttgggtaatgttatatagttattttttagagagttttagggatatataattagtttagttttattaatagtgagataagggattaggtagatttagatatttttttgtatttgattattatgttggttgttggttaaagatgttagtttttttttggaattttttagaaaggtttttgtagtatttatttatttatttatttatttatttattttatttatttatttatttatttatttatttatggattttatttattttattatttttttatatatttatttatttatttatttaatttatttatttagttttttatttatttatttatttattaatttatttatttgtttatttaatttatttatttattaatttatttatttattatttatttatttatttatttatttatttatttttttatttatttatttatttttttttttatttattttataattttatttttaaattgtgattagatggaaatgggtgtagttagtttgtttttaaaggtttagagcggaggtagagtgaattgtttatttggttttcgtgtttagtagtttaggtttgtatatatgttttataattataggatattagatttagtaattggtagtagaatgagtatagtgtatttttcgcggaattagtattgatagggtatttatttttattaagtttgagtttttttggtgttggagggaatttttagatgggttttaattttagttgaatttattttttagggaaagtaatatcgtgagaaatgcgtgtgatataaggttttaaagagggtgtgggtcgtgatttttggagtaattagggaggttttatggaggagatgaggataaagttgagttttgaaggagggatcggaggacgttgagtagggatatttatttttgtttgcgagggtttgacggtaggttgtgagttgtattttagtttcgatttatttaatttataattttagtaggtaggtgttttcgttttattttatagaggaggaagcgaggtttagggttgggtaaattgtttaaggtcgtatagttgcggaatttatttttagtatttttagtttgttttagttatgttcgtgattttatttagtattttttttttggtgtttatttattttgtttattgttaagtaataaaaattttattaggaaaatttaggggtttttggttagtttttttagatagaaaggtagatttcggcgtagatttttaggaagtaaggatggaagggttagtatttgttttttagaaatgatagtttttttaagattaggagagatggtttagagtgtagtttcggtgggttgtttaggattaggaggggagaggagcggggaggaggatgaattttatttttaaggttgttgagtggtatatagtgagtttggattttttagttttagttgagtttatttttacgatggttatgagtattttttttatatattcgattggaagtcgtattgtatataacgtatacggggttattattttttgttttatatatttttacgtatatattattagtgtattattgggatattttgttgttcggggttgagagtgaattagaattttgtttataaatttagtatattttattgtggaaataatggggggtaaggaggggtcgtttagtaaagaataggatatacgtttttgaggatggagttatttttggttgagatatttttgtaggggatgtcggcgataaaggttgttttatttttttttttgggttagatggatattatttttgttttttgttttttagtattaggtaaaaggaaaatagaagaggttttatttaggttaaatattttagggttttttattcgtaggaaatatgttggtttattttttttaaatttagtatgggggtggagaaacggtggggaaaatagtatttgttttagattttttgggtggagtttttgttttatttatattgtttatttttttgattttttaaaatgggtatttggtgtttggtagtttttggtatagagaagacgtaaagtaaatcgtttataagaagggggcgagcgtagtttgagtattttttgtttttgaataaattgttaggtttagcgtagtcgttgtcgttattgttgtttttaggaagggatttttggttacgagcggttttagtttagttttttggatttaattatttaggtttgtgtttgagtttagtaaagaggtagttagaaaagtttttaagatatttaacgatttcgtggttttagttgagaagtgagttatttttatgtgattttaaaataaaatatatttagaaggagagaagataattgaaatttagttgtttggagttattttagatgaaagtatttgagtttttgggaggtaaaggaggtaggaaagtttggagttagatgattagaatttgaacgtagatttcgttaggtttttgttgtgggttttgggagatgatttttattttttgagttttagtttttttggggatagagatggtgtttatttataggttgtttcgagttaatgaggttatatggcgtaagtattagtatagtgtttggtataaaattaaaatttaataagtgatattattattattattattattattattatttttgagatggagttttgttttgttatttaggttggattgtagtggtacgattttagtttatcgtaattttcgttttttaagtagttgagattataggtatttgttattacgtttcggttaatttttgtatattcggtagagatagggttttattacgttggttaggttggtttcgaattgattttaggtgatttgtttgttttagttttttaaagtgttcggattataggcgttagttatcgttatttggttgtgatattattataatattaatattataatagttggttaggtatggtgatttacgtttgtaattttagtaatttgggaggttgacgtgggttagttattcgaggttagttcgagattagtttgattaatatagggaaattttatttttattaaaaatataaaaattagtcgggcgtggtggtattcgtttgtaattttagttattcgggaggttaaggtaggagaatcgtttgaatttaggagacggaggttgtagtgagtcgagattatattattgtattttagtttgggcgatagagtaagattttgttttaaaaaataataataataaataaataaaatatattttgacgagatatggtaaaagatagtagaaggtaggagttcggggatttattatgggtcggcgttttaagtagaaagaaatgtagtgtttataagttagagagtagatgtcgaagataggagacgagcggggttttttggttttggagaggaaagggtgagtttaggtagaaagagtaaatttagggcgttttgtgtagtgttttttttgtggaattagtttagggtattagtagtatagtttttttttagtagtggagattaggttaattgtttagtgttttttttgtttttttgttttaattttattaagtatagtttttttttgggtatagtagttttgtaggggtggatattgatttatgtatttaggagtttagaggtttttttttttttatttatttatttagagatggagtttttttttgtcgtttaggttggagtgtagtggtattaatttggtttattgtaatttttattttttaggtttaagtgatttttttgttttaattttttgcgtagttgggattataagtatgtattattacgttcggttaatttttgtatttttagtagagatggggttttattatgttggttaggttggtttcgaatttttgattttgtgatttttttattttggttttttaaagtgttgggattatagacgtgagttattacgttcggttaggggttttttttaatggattttttttaatgtatataatttggggaatttagatataagaaagatatagagtatgaaggttttttattggtttgtttatttttagaggtggggttttaggtggtttaggttggttttaaatttttggttttaagtaatttttttgttttggttttacgttgggattataggtataagttattacgtttagttatttttttttttatttgggttgttatgttagaatttggtaagttataagatggaaatgtttaaataggtatttagaatttgagtagatattatttgatgtattattgttgttattttaatgattgaaatgtatttattatattcgtttttttaaaggttattttagatttttatagattttatttgtgatgtaagatagttattttaaatttttttgtgggttcgaatagattagatttttgaatttttgggtagagtagggatggggttgttttagaggagggtgatatcgttatatttttgttttgtttttgtgttgataatgaatgaggtttggatagttttttttttattaaaagttatatttttttaaaaaggagttttttaggatgaggcgttatgataatttaattgtgtataaatatttatttttaataatgatagaagttatttatagaaaagaatttatttttggtcgggtacggtggtttaggtttgtaattttagtattttgagaggttaaggtaggtaaattatttgaggttcggagttcgagattagtttgattaatatggtgaaatttcgtttttaatgaaaatataaaattagtttgtatgtttgtaattttagttatttaggaagttgaggtagaagaagtatttgagttcgagaggcggaggttgtagtgagtcgagatcgtgttattgtattttagtttgggtgatagagcgaaatttttttttaaaatatatatatatatatatatatatatatatatatatatatatataaatttatttttatttttttttttgaaatttttgagagaggttaggtgtagtggtttatatttgtaattttagtagtttgggaggttgaggtgggaggatggtttgaggttaggagttggagattagtttgggtaatatagtaagattttatttttattaaaaaataataaaagtttaaaaagtttttgagatagtttttggggaaaggtgggttatggagatttttattttggttattcgtgtttttttcgtttgtttttttgtggtttttttttattttgagtttggggtgggggcggtttgagtttaggatgggggtggtttgagtttggggtgggagcggtttgagtttgggatagggcggtttgagttggggtgggggcgttttaagtttgggttgcgggtattttgagtttggggtggggatgttttgagtttggggtgggggtgttttgagtttgggttgagggtggtttgagtttgtgttgggggtggtttgagttgggatgggggcggtttgagttgggatgggggcggtttgagtttggggtgggggcgttttgagtttgggatgggggtattttgagtttgggatgggggcgttttgagttgggatgggggcgttttgagtttgggatgggggcggtttgagttgggatgggggcggtttgagtttggggtgggggcggtttgagtttggggtgggggcgtttaggatgtataggttttattttttttttttgaggtttagtttgtttataggagttgtgaagggttggattaaagttaaaggtttaaattttagatttatttttagatttagtggataattaaaatatttaagtttatttttaaaggaagttgagataaggagataatggttattttttttttttttttttttttgtttttggtttttgttatttggagttgtgttttgaagaggtatattgggtattaggtttttttggttttgtttttattttttgtttagatatagaataatttttttttatttttaaggttgatacgtggggttgtggattaaagttaatttatttatttatgaggggagtaatttttttgttttaggaatttgtttttataggagaataaatattgtagaaggtattgtttttagtggtggtgtacgtttgtaattttagttatttaggaggttgaggtagaagaattgttagaatttaggaggtggaggttgtagtgagttaatattatgttattgtattttaatttgggtgaaaagattaagattttgttttaaaataaaaaaagaatagtattttgtgttaaggttaggggttttagttattttttttgtgaagcggaaggggtattattagtttttgtgagaaggaaatagtttatttaattataaaatgttaattaaaggaggtagtatattggttttggtgcggtgtcgttggtttttgtttggggtaggaggagggttgggggagagttaaaagttaaagaaggtttatggaggtcgttttttttttggtgattagttttttttttgacggtaagttgttaatagtatttggtttttaggttggggaaggtgagattagtttatatttgtttagggttttgttttgtttgtatgggtagtaggcgtttattttgttagatggttttgtttattatagggtattagtgttagttaaggatttatagagtttttttgtaaaggtttattagtgggtattgggattttgggttttatttatatagggtttttatataaaatataggatgtttagttaaatttggattttagataaataattaataattttttgaagagataaggattttgttgttttatttaagttggagtttagtggtatgattatggtttattgtaattttgaatttttggatttaagtaattttttaattgtagttttttaaagtattgggattgtaggtatgagttattaaggttagtaaataatgaattatttttaggtataagtatattttaagtttgttgtgggatatgtttatattaaaaattaatttttgtttatttgaaatttaaattgaatttattgtcgggggagataatggagtgatggattgatagaggagtatagagatagtttttttaaatttttagttgattaaagtttggtttttagtttttttgggtttttagagatgtattaagggtggaagcgattaggagggagataaaaatattgaagtttgagtgttagtattgagtcgtgtggttttggataggattgttttttttttgagttttagttttatatgttataattggttaataatagttataaagtattcgaagttaatggttgggagtttgttttaggaggtaggtattattaggatgtagagagagtgaggagtttttaaagttagtttaggttaggtatagtagtttatgtttgtaattttagtattttgagaggttgaggcgagagaattatttgagtttagaagtttaaggttgtagtgagttgtaattgtatcgttgtattttaggttgaatgatagagtttttgtttttaaaataaaataaaataaaataaaataaaataataaagttagtttgtgtattggattgtatgttgttttaaagtatttaaagtgagagaggttaggaagtaatgagatgtagaaaggtagggggaggaggtttagaggtattagagaagatagttgatttttatttttatatatttttggggtattttgagttttatttatatatttaggtgagaatttttgtatttgtgaaagtaatttgaggtcgagagaattaataggaaatcgttttattttttatgtagggtttttttataaataaggttgagtcgtagtttattattgtagttgagttttttgtagtagttgcggtggggaaggttttttaggaggtttgagtaatttagaaatatttatagtatattttttagtttttttagaggtttttgttgagatgaaagtgttttggttcgtggttaaagagtttagtatattgggtagttatagtttttattatattgatttggttattaggtttttatgaatttagtgaggggagatgggttttttagggaagtttgttgatttttttatattgttgtaaatgtaaagtttggtgattttattatttttagtaattgtgatgtagtaataataagaatagttatgtttatcgtttattgaaggtatatgatgagttagatattgtgttggtatatgtgatttttggaggtaatatatttttttttaaggaggaaatgattgagttttggagggagggttttttatttggttttaggtttttttttgatttgcgttttttttttttttttcgtttgttttattgtagtttttttggtttttttgttgtttttggaatgtattaagtttgtttttagtttagtttttgtattgttggtttttttttgtttttttaattttaatttagttgttattatttttgtgattttttattatttattttaaagtagttattagttattttttatgtaattattttattttaatttttattatagtttttagttttattttgatagtttttagaattgatgaatttattgattttgtttttttttattgtatgtaaattttaagaaataagagtttttgtttgtttattgttgtgttttagtgtttgttatagtatttggtatgtagtaggtgtttaatgaatatatttttaaaagaatgaacgattggaaggagtttgaaagaacgatggtttgtgttaatagtttatttttaatttttttagacgggatggagattattattatgtaattacgatttttttgagtttgtgtggtggttgacggtaggtgttagtttggttggattaagggatggttggtaacgtatcgtttttgggtgtgtttgtgagggtgtttttggaggagatgggtatgtgagttggtgggttgagtggtaaagatttttttttaatatggatgatattattttattgttagataataaaaaggtagagaaaaggtgaatttttttttttttttggaggtgggatgttttttttttttgtttttggatttagaatttttagttttttagtagttttttaggtttttaaatttttggttttaaattaagagttatattaatagttttttagttttgaggtttgtagatttggattgagttacgatattggtttttttgggtttttagtttgcggacggttttttgtggtatattttggtttttataatggtatgagttaatttttttaataaatttttttttatttatttattatttatttttttaattgtttatttgtttatttatttatttatttattatttattttttatttatttatttattatttatttaattaatgtatttatgtttgtttgtttatcggttatttatatttatttattaattatttatttatttattatttatttgttatttatttagttatttatttatttatttatttattttttttttttttttgagatggagttttattttgtcgtttaggttggagtgtagtggcgtgattttagtttattgtaatttttattttttaggtttaagtgattttcgtgttttagtttttcgagtggttgggattatagatatgtattattacgtttagttaatttttttatttttagtagagatggggttttattttgttagttaggttggttttaaatttttggttttaagtgatttatcggttttagtttattaatgtgttggttattataggtaagagttattgaatttaatttattatttgtttgtttgtttgtttgtttgtttgtgtttatttgtttgtttggttatttattatttatttatttatttgtttgtttgtttgtttgtttgtttgtgtttgtttgtttttatttttttgtttgtttgtttatttagttatttgtttgtttgtttgtttgtgtttgtttgtttttttttttttttgttcgtttgtttgtttatttagttatttatttatttatttattttttattggttgtttttttggagagttttggttgatgtagacggtgttttggtaagtttaggttgttatttagattattgtggagggagtgatttaaataatagatatgtattttttagtttgagaggtttaaagtttcggattaaggtgtcgttagggttagttttcggcgaggtttttttttttggtttgtatttatttttttgttgtgtttttcgttattttttttttgtttataagtgaggggggaggagagatttttggtgtttttttttttttttataaggatattaattttattagattagggttttgttttatgattttatttaattttaattatttttttaaaagttttatttttaattatagttgtattgggagttagggttttaacgtaggaatttaaggggaagggtatagtttggtttataataaatgggaaattatgtttatgattaaattttttagaagatatggtttattagcgtcgttaatgattgtaagtaaaggttagagaggaaaggggttttcgtggggtggggggcggtgggggtagttggtgtcgggaataaggtttttttttttgtttaatagtagggaagtgaggtcggttgtagatgttatttggggtgggaagagaggggagtttttgtttgtatattttgtgtgggttttggtttgattttttttcgtgttttttattttttgtgtttttttttgtgtgggagaaacgtcgatttttgttggtttaggtgtttaggtttttaggtttgttggttttgggttgggtttaattaacgagaggtttgggaggaatttgggaggtggaagtaagggagggcgcgggagttttttattttttttgttttagatagtttttttagtaggagaggtggttttttgtgtagttttagtttttgttagagttttatttttgtttgggtttttagtaggtgattttggtttttggattttggttataggatttttttttttttatttttatttaggggtggtggtggtattttgttgttaatttttaggttatttttataatgttaagaattttttttttatttgtatggtttttttttaaggtattgagaagggttttaattatatgtttatagggttaaatattttttgtaaaatttataaaatggaaaatattttttttataattaattaacgttttcgtttatttttagttttgagtttttgttcgttatatttttttttgtgtgaggtggaaacggaggtttgttgttacgtgggggtttttgttaaggagaagttgaattggaaagatatttagtttggttttggtcgggttatatttatgtagtttttatttatttttatgtatagtttagttattgttcgttatttcggtgtggaaacggattttagtaatattcgttttatttatcgttttaattttatttatcgcgtagaattaaaaattataagatacgaatatattttgcggtgtttggcgtcggaaaaacgtgcgtagtggagagaagtaagatttgaaatgtacgggtttagaagtaaatttgtggaaaattatttttattattagaggtgaagttgtaagtaaaggatttagtttttttaatgtggagttaaaatagaaaagtttttttggttagaaatatatgtataaatgttttatatgtagttagaaattttttttatttttttattttttttttgatgggaattatatttaaaaaaaaagaaaaaaataggatttattagaatttttgtgtattttgaataaaataattgtagtagtattattaattttatgttgatcgttatttttgtatatattttaattattaaaaataaaaataaaatttgattaattaaggagatttattcgttttatttatttatttatttttgagatggagttttattttgttgtttaggttggagtgtaatggtacgattttggtttattgtaatttttgttttttgggtttaagttatttttttgttttagttttttaagtagttgggattataggcgtgcgttattatatttggttaattttttatgtttttggtagagatggggttttattatgttgattaggttggttttaaatttttgattttaagtgattcgtttattttaattttttatagtgttggaattataggcgtgagttattacgtttagtttatgtttttttttgttgttttttttttttttttgagatatggttttatttttttatttaggttggagtgtagtggtatgattacggtttattgtagtttcgattttttgggtttaagtaatttttttattttagttttttaagtaattgggattataggtgtatgttattatgttttgttagtttttgtatttttagtagagacggggtttcgttacgttgttcggatcggttttgaatttttggttttaagtgatttatttgttttggttttttaaagtgttgggattataggtacgagttattgtgtttagtttgattagttttttgttttcgaaatagaaaacgatattataaagttattatattgaagaagtaatgttaaaaatgtgggagaaatagaattttggagatatgattgatagttgattggtatttttttgtatgtagtgatgtttgtgatatttaatagttgtttataatttataatttgttgttatttatttttttattttaaatgaattattgtatttatatttttagagggttgtataagtttatattattttgattttttgttgattgtttttttgttttttgtttggtttttattttttttattatttgtgtaattagtttttcgtttttaagtttttttgttttaaatgtttaagtggattaggtattgtggttttcgtttgtaattttagtattttgggaggtttaggtaggaggattatataaatttaggagtataagattaatttgggtaatatagtaagattttgtttttatatatatataaaaaatataaaaattagtaaggcgtgatggtatatgtttgtagttttagtattttgggaggttgaggtaggaggattgtttgaggttgggagtttaggattagtttgggtaataaagtaagattttgtttttataaaaataaaagaaaaaattaggtaggtatatagtgtgtatttatagttcgagttatttgggaggttgagaagggaggatcgtttgagtttaggagtttaaggttgttatgagttgtgattatattattgtattttagtttgcgtgatagagtgagattttgttttgggaaaaataaataaataaataaataaataaataaataaataaatgtttaagcggtttttattttttggttagattttattatatattttatgaataaatcgtatgtatgagaaaggtgagtagatgaatagggtagggttagggggttaaggggaagattatagattacgtggagcgagattagtggttaaaaattgttaattatagttaggtttggtggtttatgaaggtaattttaacggtcgggtttggtggtttatgttcgtaattttagtattttgggaggtcgacgcgagtttattatttgaggttaagagttcgagattagttcggttaatgtagggaaatttcgtttttattaaaaatattaaaattggttaggtatggtggcgggcgtttgtagttttagttatttgggaggttgaagtaggagaattggttgaattcgggaggcggaggttgtagtgagttgggattttattattgtattttagtttgggcgatagagcgagattttattttaaaaaatttaaaaaaaaaaaaataaaaaattgtagattttaataaggaagagttataggacgatattttaggatgcgggaaaaggttacgttagttttggattttttttgattaatgggtattttagttattaaaggggtagatgcgttttatttaatttttatttagttattagagtataatatagggatgtgttatagatagagatggagattaataggtagaggggtgatggggaggaagattgaggtaagaggaataaaacggggattgtagagggtaggtggtaggagtttgagggttttagaagaaattgttgtataagtaatgagttagtagggtgagtgacggttaggagaggtggtttaagaaaataaagagatattttcgggggtatagatgcgttttgaggggtcgaggaagagatggggaaggggtggttttgtggattttcggtatgattgtcgtggtgaaaaggaattaaagatttcgataaggggatgattttttaaataaggaagttttgggttttcgtagggggattagtagattgagggtaaacggtattttgtttattaaagttttaataaaatgttaaggtaagaatatttgtttggttttgggggtaattttagaaatattagaaaagggatttattatgcgtaatttttttttaattatttggagaaatgtatggttatttaagatagagaaaggtagttaaagtaagtggaggttaggtatagtgatttacgtttgtatttttagcgttttgggaggttgaggtaggaggatcgtttgaggttggaaatttagtattagtttaggtaataataaaataagattttgtcgttataaaaataaaaataaaaattttttgagacggagttttattttttttgtttaggttggagtgtcgtggtacgattttagtttattgtaattttcgttttttagatttaagtaatttttttgttttagttttttgagtagttgggattataggtatgtgttattatgtttagttaattttgtagttttagtagagatagggtttttttatgttggttaggttggtttcgaattttcgatttttttggttttttaaagtgttaggattataggtatgagttatcgcgttcggttgttataaaaattttttaaaaattagttaggtatgttaggcgcggtggtttttatttgtaattttagtattttgggaggttaaggtaggtggattacgaggttaggagtttgagattagtttgattaatatggtgaaatttcgtttttattaaaaatataaaaattagttaggtgtggcggtatatgtttgtaatcgtagttatttaggaggttgaggtaggagaattgttttaatttaggagtcgggggttgtagtgagtcgagattgtattacggtattttagtttgggtaatagagtaagattttgttttaaaaaaaaaaaaaaaaaaaaaattagttaggtatgtagcgtatatttgtagttttagttatttaggaggttgagaagggaggattaattgaaattgggaggtcgagattgggaggttatgattacgttattgtattttaatttgggtaatatagtaagattttgtttaataataataataataaataatgtaagtgggtataagaatttatttatttatttatttatttatttatttatgagatagggttttattttgtcgtttaggttggagtgtattggcgtaatttcggtttattgtaagtttcgtttttcgggtttatgttatttttttgttttagtttttcgagtagttgggattataggcgttcgttattgtatttagttaattttttgtatttttagtagagacggggttttattatggtttcgattttttgattttgtgatttgttcgtttcggttttttaaagtgttgggattataggtgtgagttatcgttttcggttttaagaatttattttattttagtattttggaggttgaggcgagtggattacgaggttagaagattgagattattttggttaatatggtgaaatttcgtttttattaaaaaaatataaaaaattagtcgggcgtgggggcgggtgtttgtagttttagttatgcgggatgttgaggtaggagaatggtgtgaattcgggaggcggagtttgtagtgagcggagatcgcgttattgtattttagtttgggtaatagagcgagattttattttaaaaaaaaaaaaaaaagaatttattttaagatagtaagttttagggttgaagttagtttttatttagttttaggtttaaagttataagtatggttattgtaatatttttatttaggatattattttttaggggtttagatttatattattaaggaggagcgtttatattagtagttggggagagggtggttttttataagatgtaatgtttattttgaagagttattatagtgataattatgaaatttatgtttgagatttaattttaagtgaaaagaatagaatttaatatttattttatggggagtataaaattttgaaaatatacgttttttataattaaattaaattttatgttatgtttttgaggagataagtattgaatggaatatagaagaaatgttatagttaatgattgttgaagttttttttttaattttttgtttatgttgtttggtaataagtaatatagaaaattgataataaaaagtaaaagagaaagaaaagatatagtgtatagtttagattgttttttttaaaaaattaaataataataataaaaagtataggtcgggtgcggtggtttacgtttgtaattttagtattttgggaggttaaggcgggcggattatttgaggtcgggagttcgagattagtttgattaatatggggatatttcgtttgtattaaaaatataaaattagtcgggtatggtgacgtaggtttgtaattttagttatttgggaggttgaggtaagagaatcgtttgaattcgggaggtggaggttgtagtgagttgagatcgcgtttttgtattttagtttgggtaataagagcgaaattttattttaaaaaaaaaaaaaaaaaagtataaatgtaagttgggcgcggtagtttatgtttgtaattttagtattttgggaggtcggggtaggtggattatttgaggttaggagtttgaaattaattcggttaatatggcgaaattttatttttattaaaaatataaaaattagttaggtatggtggcgcgtgtttgtaattttagttatttaggaggttgaggtaggagaattgtttgaatttaggaggtagaggttgtagtgagttaagattgagttattatattttagtttgggtgatagagtgagatttcgttttaaaaattaaattaaattaaattaaataaaataaaaaaaagaagcggtataatataaagtttcggtagttaaagcgttaatttttagttattaggaaggttttgttatttaatgatttatcgttttagttaaggttagttatattttgggtttttgatgttggaggtaatatgatgttaatattggcgagaaatttattattttttttttttcgtttttcggtgtcggtttttgtgtgtatttgtagtttttttattatcggtgtttttatggtgtttacgttatcggtttattttttagtaataattcgatagttcgatatttttgtagattttgtggttatagagttaaagttttttgttattagtgggttttgtagataattttttaaatttttttgggttgagttagttaagtttttaataagttggaagatgataggggttggatgtaatttatttttaattggtttgggttatatggatattattttttttttgggatttgatttgggatggaaataggagttatagtttatgggaaggttgtgaaaggaagtttcggttttagggtgcggattaggttgatttgcggaataaggttttaggggcggtttattcgtttgttttgtttagttttttttggtaattatatttattcggggtttattttaaatttggtaggtaatgttgttgtttttattttagtcgttgttttaatacgtttcgtttggttaggataggtgtttaggtatggtatttagggatattttcggttttcggggtttaatttttggtttttaggtgtagcgttgggaaaagtagagggtttcggttatggcgtaggtttcgttataggttatttaagtagtttgggaggagtcggaaagagagtaatgtatttatttggatagagattgaagttatatttttattgagaaaagatgatatttttgtttggattttttttttgaaattttaggtcggggtggggtaggagttagcgagagagtttagcgttttaaaggggattttttggtttttcgtgttttttaatttagtatttttggggatttatatatttagggtagagtggttatttagggttttttttatttagatataaaggttattgaaggtttcgggttaatatcgttttgaggatgattagcgatttgagtttttgttagagatagtaggtagtttgggtttaagggtcgtttagtgatttgaagttgggattattttatattttttgcgttatttttgttttttgttttggaggtttttaggttgttaatagttatgttttggagaattaggttagattaggttgggaataaagtttagttgttatagagttgtcgagaggttattggtaagtagtgtttaggagtcgttttttttttgttagtaatagtttaatgtttttttttataggggttgtaaatgggtttatgtttagggtggggttagggagataaagtagagagaaattgggttgggagtagagagtgttatgttttattttggagatttaaggttaggttattttgtagagttggtgtttagagtttttagcgtataggagaggaggtaaatagaatttgatatttagtagcgttcggtagacgtttttggaatgaatgattaaatttatatggagagttgaaatgggttaggaattttagggagacgggtagtttatagtttagtagggtcgttttagtagagtaggttaatgttaggttttttggtaaatttttcggggtttaggtataattgttatattaggaaaggggtaggggtgattagtttatcggttacgggggtattttattgtttttatagaagttcggtatttataggtttgggtgatatacgatttttatgtttggtattacgatggttgtttattaagtttttttatttattaggattgattttttttggttagcgattttagattattatgatttggtagttgtcgttaggtttgtttggttaaggattttttcggagattgagttattttatatagtaaagtgagttatggggttatagcgttgtgtgttgtgtataagtttcgagggttttatttagggattggtatttattgatttttataaatttttggtaatcgtttagagttgggatgtttttaaggtaatagttttaataaatagaggcgtaggaatttagcgcgttatttttcgttttattttaaaggtttatatttttaggggtttggagtttttttttggagttttttttattttaaagttagttggatttgtttaggaattgttattattattttttggtcgggtttgtattgatgtgtattgaattttttttattaggtttattttaggtaaattttagagtttacgtaatattgtttgtggataaatattggggcggaaataggggttatttttaggttttagttatatggggttgttagggttgtttgggatggtaggagagtgttagaggagggtagtttaaggattaggtagggggtgggaagtgtttttttttatgggtttttaagtgagatgttttttgtaaatatttatttgggatttttaagtagagggttggtttttatgttatttggatttggattttagattattgtttttaagtggtaattttgggtttttttgtatttgttttggtttgagttggttatatttgtggggggtggttttaggaagaaggtggattgtcgtaaacgtaatgtttcgttgttaggtgtattgttttcggttattagaatttttttgggtaggtcggggagatttgacgggtaagtgtttgcggtttggcgtgagcgggtagggtaggtggtttttgtttgggtatgtttttttatttttgtaatagattagggagagggttggttttaggatttaggtttagttagttgttttataattgaggggtttcggcggaggatataagttagatagagttatagattaatcgtacgaggtggttttttttttttagtttaggttttttgaatgcgttagagtagataagtttggacgtgaggaggtaagaggtagcgagaataggcgcggagacggggttgggggagaagaggaagaaattttgtgtttgtgttttttttacgttcgtttgttatcgggttagttgattggggaagtgttttttgagggtgtaattttttgtttttttcgtaagttagttttcggggcgttgggtgagggtgtagttttgtttattacggcgagttagtatattgaattacggtagaagttgttttttgtgtgggtgtagtttttttttttgtttaggatttagaagttacgatagtatagagttttttaatcgtggttggtgtttttttaggaattttttgaaagttatagagaaattttagagtggttgggtacggtggtttatgtttgtgattttagtattttgggaggttgaggcgggtggattatttgaggttcggagttcgagattagtttggttagtatggtaaaattttatttttattaaaaaatataaaaattagttgggtacggtggtatatgtttgtaattttagttatttaggaggttgaggtatgagaattgtttgaatttgggaggtagaggttgtagtgaatcgagatcgtgttattgtattttagtttgggtaatagagtaagattttattttaaaaaaataaaaaataaaaaaagaatttttagagtaatttttaggtgttagtaggggtgtgacgtaattttagtttcgtttttgtggtttatcggtttcgggtaagtttttttgtcgttgttatttatagagagtttttaggggagtttgggaatgacggtaagttttatgtgatttagtatgtaaagggagttttaaaatttagaatttagagagttagggcgggtatagtgtagttggttttagtgttgaggggttgggggagagattttgtattatgttttgattatagtaagggaagattatggaggtttttggaacgttttagtaatggcgtaattttagttttttttatttttttgttaatgataattatgattatgatagtagttaataggttatagagtaggtattttttagtttttttaaatatgaattcgtttaatttttataataatatagtattgttttatttaataaatgaggtaggttgggcgtggtggtttatgtttgtaattatagtattttgggaggttaaggtaggtagattacgaggttaggagttcgagattagtttgattaatatggtgaaattttatttttagtaaaaatataaaaattagttgggcgtagtggtacgtttttataattttagttatttaggaggttgaggtaggagaattatttgaatttgggaggcggaggttgtagtaagttgagattatgttattgtattttagtttgggagatagagtgagatttcgttttaaaaataaataaataaataaaattaaaaaatattatatatataaaaaaataaatgaggtaaatgagatgtatgaggtgagaattttgtgttatagggagaggcgtagtttggtgagatttaattttaaggggttggcggttttgagtttttaagtgtaattattggattatattgtttgtagattattattatttttattttattggaaggtcgggtgaggtaatcgggaaagtttggagtagtagtggagttgttagagagaatttgtttttagtgtttttttggattttgtagttgttttgtgtgggtttttgttgtttttcgtattggaaaagatttttttatagatggggttttatgacgttatttaggttggagtgtcgtgtttatttttaggcgttgttatagggttgtagttttgaatttttggttttaagcgatttttttgttttagttttttgagtagttttttgggtttaagcgattttcgtgttttagttttttgagtagttttttgggtttaagcgattttcgtgttttagttttttgagtagttgggattttaagcgtatttggttaagtttttttttattttttattatttaagatttttttttttttaaggtttagtttaattttatttttatttaaaattttcggggtatttttgtagtatttggaggttgaattgtttaggagggaagggtgttaatgagttggtgtttcgtttttattttgattttcggtgagaatgtaagttttttgtaggtaaggattatattttattattatttttgtatttatttagatttggttatgtgtgtttagtatataaagtgttttcgatgattgtttatagatttacggtatttgagattgttttaatatatttttttaaaattttttttttttttagaggtttacgaatgtttaaattaggtttatcgggaataatattatggttatttcgtttattttgaagtttatatataggtttggaagtaataatttcgtatagtttagatgaaaaaataaagatttttttgttgtttttggattgttagagttttgggggatttttaatattttttgttgttttttttaattttatggtgtcgatggtttgttggggggttagtttgatttttgcgagtgttcgtattcggaaaagggttggtgttaagatagttttaggatatttagaatgagggtaagaggttatttttattattagttttttttagttttattttatataattgtaatatagtgatttagtatattttgggttattgttaagtagggagtaaattagaaatggtttgagttttttttttttttatttttagaggggtttgtttttttaggtaaatataaggaggtatcgaggttgttgtataagagttggtttttgtttattttataaattttatttttatttattgtaaaaggttttgtttttttttttaaaaaaaaaaaaaaaaaagaaatttagtgaggggtggggtaggtgtgtgtggaggagaggagaaaaggataagtgatggtttttttattttttagtaagtcgtaggtgtagagattttaagtttgttttagggttttttcggtatttgtgtaggagggttttcgtagaaaaaatttaggatttacgatttgggaggatttcggttatttttattgtttggatttattagtgggaggtaaagtgtaagaaattaagggtaaagggttttttttgggcgggttagagattttttggaaagggttatgtatcgcgcgatttttataataattttaagtatttggagtatgttggggaggaagtttcggtgttaaaattaagtatgtgttatttggaagttcgttttcgtttattagtatattaatttatttacgtttttgatagagttgtgtttcgggtgcgtagagggttattttgttcgtaataatcgggtgaaagttgaaattttaagttattgatttagaagggtattttcggggaagttttgagtaattttttttgagataaggtattttattatttattttggtttttaaatatggaaagttagaggaaatcgataatggtttaaaggtagggggatggtttcgatgatttttttatttttaattaaggtttatgattttgtttttttattaataaaaattaatttatggatttttggtaggtatttttttatttgaatgaattaaaggagggatattaaataaacggtttttagatttagaagaggagacgttatttataatttgaggattgaggaggataaaggattttgtttgtttggattttttggagaaaattataaaggaaaaaaaaaaggaaggaaaagataaataatgaagatttggattttttttaatttgtttttgtggtttcggtgtgtttatttgtgaaatggaattttagagtgttagagcgggagttttttatgaaatgaaagtttttgaatcggtttatggtgaggtttaagttaggtttttttcgtttatttaaggcgggttttgttagggtggagtgaggatgttagtcgcgggcggcgttttgagcgtaaaacgtgaattcgagtcgttaagtttgggcgttgttggacggttttatttggaggtcgtttcgtgttttattaagtagaggagaaatcgaagagaattcgaagaaaggatgttgcggtttggattattagttttagaggttgaatttaaggatatttttttatttagtttcgattttatttatttatatagacgtatagggatttaaagtattcggtcgatttggaaagttagcgatttttgcgagggtgtaaggggcgaggaagagggagcgttttttagggtagttttttcgatattcgagtaagggttggagatagcgtaggggacggtcggtttaggtcgaaagcggttcgatagcggttttgttttgggaggaattcgatttgtagtgtgttcgtcgcggggattcgtttagtttcgggggcgtttcgttattttcggtcgtaggtatttaggtgagtagcgttggtttcgggatatcgatttttttttatttcgggcgcgaagtttatttgagtaagatttttttatggtgttttcgtggtcgtcgtttttaggaaagtgtggcggcgaggtagcggggcgcgcgtttttagggcgttaattttgggtcggtagtaggaaggcgggaagagggggcggttcgtcgtttggagtgtatcgatcgggtttcgtttcggtttcgttttcgtttcgttttttttcggagatgcgtatagaatttcggtttagtcggttgtggtttcgtttttgattcgtttttttttcgtttcgtgaacgtgcgcgtcgagttttattttcgtttatttttgcgttgcgttgtatttggcggagcggggttggcgggcgtcgggtttgggagggggcgttttcgcgcggtagcgtagattagattagattaggttaggtcgggggtgggggtcgtttgcgtggttcgtcgcgttcgtagttttgtatttttagtttttcgcgttggcgttaatggttggtttcgggagtcgtcgtattttttagtttcgagttcgggcggggcgggttcggttaggtggaagcgggcggaggtgcgggcgtttcgggcggtttcgtcgggcgaggcggcggcgtcgggtatcgcggcggcgtcgggtatagtcgggggtcggagtcggggtgtcggtttagtgggtcggggtagggcgggataggatatttgttttgttatttttttggtaattaaaagggtagagtgcgtcgattgagttggagttttagtttttttatttgtaaatgggcgcgttggatagatgattatttgttttttttgcgttgggtatcgtgcgtagttcggtgtatcggtgtagcggggtagatatagggagtcgttttttataattcgggtaacg

SEQ ID NO: 6 - DNA, 1405 bp, Artificial Sequence
  source 1..1405: /mol_type="DNA" /note="chemically treated genomic DNA (Homo sapiens)" /organism="Artificial Sequence"
cgttattcgagttgtaaagggcggttttttgtgtttgtttcgttgtatcgatatatcgagttgcgtacggtgtttagcgtagggagaataaatgattatttgtttaacgcgtttatttataggtgaggaaattaaggttttaatttaatcgacgtattttgtttttttgattattagaaaagtagtaggataggtgttttgtttcgttttatttcggtttattaagtcggtatttcggtttcgattttcggttgtgttcggcgtcgtcgcggtgttcggcgtcgtcgtttcgttcggcggggtcgttcggagcgttcgtattttcgttcgtttttatttggtcgggttcgtttcgttcggattcgggattgggaagtgcggcgattttcggaattagttattggcgttagcgcggggagttgggggtgtagagttgcgggcgcggcgggttacgtaggcggtttttattttcggtttggtttggtttggtttggtttgcgttgtcgcgcgggggcgtttttttttaggttcggcgttcgttagtttcgtttcgttaggtgtagcgtagcgtaggggtgggcgggggtggggttcggcgcgtacgtttacggggcggggagggggcgggttaggggcgggattatagtcggttgggtcggggttttatgcgtattttcggggaggggcggggcgggggcggggtcggggcggggttcggtcggtgtattttagacggcgggtcgtttttttttttcgtttttttattatcggtttaggattagcgttttgggagcgcgcgtttcgttgtttcgtcgttatatttttttgggagcggcggttacggaggtattatgaagaagttttatttaggtgggtttcgcgttcggggtggggaggggtcggtgtttcgggattagcgttgtttatttgagtgtttgcggtcgggagtggcgaggcgttttcggagttgagcgagttttcgcggcgggtatattgtaggtcgagttttttttaggatagggtcgttgtcgggtcgttttcgatttgagtcgatcgttttttgcgttgtttttagtttttgttcgagtgtcggaggggttgttttgggggacgttttttttttttcgttttttgtattttcgtaggaatcgttgattttttaggtcggtcgggtgttttgggtttttgtgcgtttgtgtgggtgaatggggtcggggttaggtggaggggtgtttttgggtttagtttttagggttggtggtttaggtcgtagtatttttttttcggatttttttcggttttttttttatttagtggggtacgggacggtttttagatgggatcgtttagtagcgtttaaatttggcgattcgggtttacgttttgcgtttaggacgtcgttcgt

SEQ ID NO: 7 - DNA, 1405 bp, Artificial Sequence
  source 1..1405: /mol_type="DNA" /note="chemically treated genomic DNA (Homo sapiens)" /organism="Artificial Sequence"
gcgggcggcgttttgagcgtaaaacgtgaattcgagtcgttaagtttgggcgttgttggacggttttatttggaggtcgtttcgtgttttattaagtagaggagaaatcgaagagaattcgaagaaaggatgttgcggtttggattattagttttagaggttgaatttaaggatatttttttatttagtttcgattttatttatttatatagacgtatagggatttaaagtattcggtcgatttggaaagttagcgatttttgcgagggtgtaaggggcgaggaagagggagcgttttttagggtagttttttcgatattcgagtaagggttggagatagcgtaggggacggtcggtttaggtcgaaagcggttcgatagcggttttgttttgggaggaattcgatttgtagtgtgttcgtcgcggggattcgtttagtttcgggggcgtttcgttattttcggtcgtaggtatttaggtgagtagcgttggtttcgggatatcgatttttttttatttcgggcgcgaagtttatttgagtaagatttttttatggtgttttcgtggtcgtcgtttttaggaaagtgtggcggcgaggtagcggggcgcgcgtttttagggcgttaattttgggtcggtagtaggaaggcgggaagagggggcggttcgtcgtttggagtgtatcgatcgggtttcgtttcggtttcgttttcgtttcgttttttttcggagatgcgtatagaatttcggtttagtcggttgtggtttcgtttttgattcgtttttttttcgtttcgtgaacgtgcgcgtcgagttttattttcgtttatttttgcgttgcgttgtatttggcggagcggggttggcgggcgtcgggtttgggagggggcgttttcgcgcggtagcgtagattagattagattaggttaggtcgggggtgggggtcgtttgcgtggttcgtcgcgttcgtagttttgtatttttagtttttcgcgttggcgttaatggttggtttcgggagtcgtcgtattttttagtttcgagttcgggcggggcgggttcggttaggtggaagcgggcggaggtgcgggcgtttcgggcggtttcgtcgggcgaggcggcggcgtcgggtatcgcggcggcgtcgggtatagtcgggggtcggagtcggggtgtcggtttagtgggtcggggtagggcgggataggatatttgttttgttatttttttggtaattaaaagggtagagtgcgtcgattgagttggagttttagtttttttatttgtaaatgggcgcgttggatagatgattatttgttttttttgcgttgggtatcgtgcgtagttcggtgtatcggtgtagcggggtagatatagggagtcgttttttataattcgggtaacg

SEQ ID NO: 8 - DNA, 2365 bp, Artificial Sequence
  source 1..2365: /mol_type="DNA" /note="chemically treated genomic DNA (Homo sapiens)" /organism="Artificial Sequence"
gtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcgcgggcgcggcgttttagttagcgcgtagggttcgggtttcgtcgggggcgttttttcgtcgttgtttttcgcgcgattcgttgtttattagttattatgtcggatttcgcggttaacgcgtagttggatgggattatttcggatttcgaaggtgggtgttgggttggttgttgcggtcgcggacgtgttggagaggattttgcgggtgggtttggcgcgggacgggggtgcgttgaggggagacgggagtgcgttgaggggagacgggatttttaatttaggcgttttttcgttgagagcgtcgcgcgttttcggtttcgtgttcgcgtcgtttacgtgggggattttgttaggggtattcgcgtagattttgcgcgtttttataggattttgtgttcgttttgcgtattgtcgtttgggtttttttttttttattgttgtttgtgtttgttaagcgatagcgattttttcgagggttcgcgaggttgtttcggaattttttaggacgtatagttttattttgggaaatttatcggttttttttttttggtttttttcggcggttttcgggtttcgtttggattcggtaacgggatagggaggtcgttttttattttcgattgagtggatagtcgcgttttgttcgggtggatagttttttttttttttacgttagtttcggggtcgttaagttgtgtagttcgtgggtcgggagtatcgaacggatatagtttaggtcgtggtagggtttagagtgggatgttttatggtttttatttaggtttggggatatttttattcgttttttagaatcgggtcgtgggggatagaaggggtttgcgtgcgggtagggagagtattttggtttttttttgttttcggggtttataaagtgtgttgggatttgcggggttgttttgtttaagtttgggtttggcgttcgcgtttttgagtttgtgagtgcgtgcgtttttttgcgtttttttgattgtcggtgttggggttttgcgttttgcgttcgcgggagtaaatatagtaggcgaaggggaagtttatataatggtttttagcgttttggggtagggtttttgaggggcgggtttgtttttgtcgggatttggagttttcgtttttcggagaggtttttaggttgatttgggtagagttttttggtgggtcgggagggggaaaggttgtgttgaaatgagtaaattgtttaggtgttaggttaagttgggaggtgattagtttgaggtttttttcgttttatggttagaattagggttgatatttgggtgttttgagtttagttgtttatacggtttatttggggttagttttatttgagtgggggaggcggggttttttgggggattagaattttggttggacgttaagtagagtgttagtggttgttttttagggttgggtttgaggagggtgtggggcggcgaagggacgggagggggttgtgatttagtggttattggcgttgtgtagagtgtgagttggaaatatcgtagttattttgttagtttagtggtgaaagtttttttttaggttttatttttttgtatttttgttttttagagggaggggaggtttgggtttgtagagttgggagggtttgttgttttcgttttttttttttataatatttttttatttggatatttttgggtatatgt

SEQ ID NO: 9 - DNA, 2365 bp, Artificial Sequence
  source 1..2365: /mol_type="DNA" /note="chemically treated genomic DNA (Homo sapiens)" /organism="Artificial Sequence"
gtatgtgtttaaagatgtttagatgaggaggtgttgtgggggaggggggcgggaatagtaagtttttttagttttgtagatttagattttttttttttttgggaagtagggatgtaaagggatagagtttgaaaaagggtttttattattaagttgataaagtaattacgatgtttttagtttatattttgtatagcgttagtggttattggattataattttttttcgttttttcgtcgttttatattttttttaggtttagttttgaagaatagttattggtattttgtttggcgtttagttaaagttttggttttttaggaggtttcgttttttttatttagatagggttgattttaggtgggtcgtgtgggtagttgggtttaggatatttagatgttagttttggttttggttatggagcggggaggattttaggttggttattttttagtttggtttgatatttggatagtttgtttattttaatatagtttttttttttttcggtttattagagggttttgtttaagttagtttaggagttttttcgaggggcgggggttttaggtttcggtagaggtaggttcgttttttagaagttttgttttagagcgttggagattattgtgtgagtttttttttcgtttgttgtatttattttcgcggacgtaggacgtagagttttagtatcggtagttaagaggacgtaggaaagcgtacgtatttataggtttagagacgcggacgttagatttaggtttggatagagtagtttcgtaagttttaatatattttgtaaatttcgaagataggagagagttaaaatattttttttgttcgtacgtaggttttttttgttttttacggttcgattttgggaggcggatgaggatatttttaggtttggatgggggttatgggatattttattttagattttgttacgatttgggttgtgttcgttcggtgttttcggtttacgggttgtataatttggcggtttcgaaattggcgtgggggaggggagggttgtttattcgagtaggacgcggttgtttatttagtcggaggtgaggaacgatttttttatttcgttgtcgggtttaagcggggttcgagagtcgtcggggagagttaaagggaggggatcgatggattttttagagtgaaattgtgcgttttggagagtttcgaggtagtttcgcgagttttcgaggaggtcgttgtcgtttggtaaatataaataataataaaaggaaggaaatttaggcggtagtgcgtagaacgagtatagggttttgtgagggcgcgtagggtttacgcgggtgtttttaatagggttttttacgtaggcggcgcgggtacggggtcgggggcgcgcggcgtttttagcgggagggcgtttggattaggggtttcgtttttttttagcgtattttcgtttttttttagcgtattttcgtttcgcgttaggtttattcgtagggttttttttagtacgttcgcggtcgtagtagttagtttagtatttattttcgaagttcgaaatgattttatttagttgcgcgttgatcgcggggttcgatatgatggttggtgggtagcgggtcgcgcggagggtagcggcgaggaagcgttttcggcggggttcgggttttgcgcgttggttggggcgtcgcgttcgcgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattat

SEQ ID NO: 10 - DNA, 219909 bp, Artificial Sequence
  source 1..219909: /mol_type="DNA" /note="chemically treated genomic DNA (Homo sapiens)" /organism="Artificial Sequence"
tgttatttgagttgtaaagggtggttttttgtgtttgttttgttgtattgatatattgagttgtgtatggtgtttagtgtagggagaataaatgattatttgtttaatgtgtttatttataggtgaggaaattaaggttttaatttaattgatgtattttgtttttttgattattagaaaagtagtaggataggtgttttgttttgttttattttggtttattaagttggtattttggttttgatttttggttgtgtttggtgttgttgtggtgtttggtgttgttgttttgtttggtggggttgtttggagtgtttgtatttttgtttgtttttatttggttgggtttgttttgtttggatttgggattgggaagtgtggtgatttttggaattagttattggtgttagtgtggggagttgggggtgtagagttgtgggtgtggtgggttatgtaggtggtttttatttttggtttggtttggtttggtttggtttgtgttgttgtgtgggggtgtttttttttaggtttggtgtttgttagttttgttttgttaggtgtagtgtagtgtaggggtgggtgggggtggggtttggtgtgtatgtttatggggtggggagggggtgggttaggggtgggattatagttggttgggttggggttttatgtgtatttttggggaggggtggggtgggggtggggttggggtggggtttggttggtgtattttagatggtgggttgttttttttttttgtttttttattattggtttaggattagtgttttgggagtgtgtgttttgttgttttgttgttatatttttttgggagtggtggttatggaggtattatgaagaagttttatttaggtgggttttgtgtttggggtggggaggggttggtgttttgggattagtgttgtttatttgagtgtttgtggttgggagtggtgaggtgtttttggagttgagtgagtttttgtggtgggtatattgtaggttgagttttttttaggatagggttgttgttgggttgtttttgatttgagttgattgttttttgtgttgtttttagtttttgtttgagtgttggaggggttgttttgggggatgtttttttttttttgttttttgtatttttgtaggaattgttgattttttaggttggttgggtgttttgggtttttgtgtgtttgtgtgggtgaatggggttggggttaggtggaggggtgtttttgggtttagtttttagggttggtggtttaggttgtagtattttttttttggattttttttggttttttttttatttagtggggtatgggatggtttttagatgggattgtttagtagtgtttaaatttggtgatttgggtttatgttttgtgtttaggatgttgtttgtggttgatatttttattttattttagtagggtttgttttaagtaggtgaagggggtttgatttgggttttattatgagttggtttaggagtttttattttataagaggtttttgttttggtattttgaagttttattttatagatgggtatattgaggttataagggtaggttaagagaaatttagatttttattatttgtttttttttttttttttttttttttttgtggttttttttaaaggatttaggtaggtaggattttttgttttttttagtttttaaattataaatagtgtttttttttttaaatttagaaattgtttgtttaatgttttttttttaatttatttagatagaaaggtatttgttaaggatttatgaattaatttttattgataggagaatagaattatgggttttagttggaggtgaaggagttattggggttatttttttgtttttgggttattgttggttttttttggttttttatatttaggaattaaaatgagtgataaagtattttgttttaaagaggattatttagaatttttttgaaaatatttttttgggttagtagtttagaattttaatttttatttggttgttgtgaataagatggttttttatgtatttggagtatagttttgttaggagtgtgggtgggttggtgtgttggtgggtgggagtgggtttttaggtggtatatgtttggttttggtattggggttttttttttaatatgttttaaatatttgagattgttgtggggattgtgtggtgtatggttttttttaggggatttttagtttgtttagggagggttttttgtttttggttttttatattttattttttattggtgggtttagatagtgggggtgattggggtttttttaggttgtgggttttgggttttttttgtggagatttttttgtatagatgttggaagggttttgaggtaggtttggagtttttgtatttgtggtttattgggaggtggggagattattatttgtttttttttttttttttttatatatatttattttattttttattgggttttttttttttttttttttttaaaaaaaaggatagaattttttgtagtaggtggaagtagagtttgtggagtgagtaggaattaatttttgtatagtagttttggtgtttttttgtgtttatttaaaggggtaggtttttttgaggatgggggaagggagggtttagattatttttggtttgttttttgtttggtagtggtttaaggtgtgttgggttattgtgttgtagttgtatggagtgggattggagggggttgatggtgggggtggttttttgtttttattttgagtgttttggagttgttttggtattagtttttttttgggtatgggtatttgtaggagttaggttgattttttaataagttattgatattatgaaattaaggaaagtagtaaaagatgttaaaaattttttaaggttttgataatttaaggataataggaaggtttttatttttttatttagattgtgtgggattattgtttttagatttgtatgtgggttttagaataaatggaatgattataatgttgtttttggtagatttggtttgaatatttgtgagtttttgaaaaggagaaagattttagaaggatgtgttggggtaattttaagtattgtgggtttatagatagttattgaagatattttatgtgttgggtatatatggttaagtttgagtgggtatagaaatggtaatgagatatagtttttgtttgtagagaatttatatttttattgggagttaggatgagggtgagatattagtttattaatattttttttttttgagtagtttagtttttaaatattataggaatgttttggaggttttaggtggaggtgagattgagttgggttttgaggaaggagaagttttgagtagtggagaataaaaagggatttggttaggtgtgtttgaagttttagttatttaggaggttgagatatgaggattgtttgagtttaggaggttatttaggaggttgagatatgaggattgtttgagtttaggaggttatttaggaggttgagataggaggattgtttgaagttaggagtttaaggttgtagttttgtgatagtgtttggaaatagatatggtattttagtttgggtggtgttatgagattttatttgtaagaaggttttttttaatgtggaaggtagtaagggtttatatagggtagttgtaggatttagggggatattggggataggttttttttggtagttttattgttgttttaggtttttttgattgttttatttggttttttaatggggtggaggtagtggtagtttataggtagtgtggtttagtggttatatttgggggtttagagttgttagttttttgggattaaattttattaggttgtgtttttttttgtggtataaggtttttattttatgtattttatttgttttatttgtttttttgtgtgtgtggtgttttttaattttatttatttatttatttttgagatggagttttattttgttttttaggttggagtgtaatggtatgattttagtttattgtaatttttgttttttaggtttaagtgatttttttgttttagttttttgagtggttgggattgtaggaatgtgttattgtgtttagttaatttttatatttttattagagatggggttttattatgttggttaggttgattttgaatttttgattttgtgatttgtttgttttggttttttaaagtgttgtgattataggtatgagttattatgtttagtttgttttatttgttaaatgggatagtgttatgttgttgtaaaggttaaatgagtttatatttgaaaaagttgagaaatgtttgttttgtaatttgttagttgttgttatgattatgattgttattgataggaggatggagaaggttggggttatgttattgttaggatgttttagaagtttttatgatttttttttattgtggttagagtatggtgtagggttttttttttagttttttagtattggagttagttgtattgtatttgttttggttttttaggttttgagttttgggattttttttgtatattaggttatatggaatttgttgttatttttaggtttttttggaaattttttgtgggtggtagtggtaggaggatttatttgaggttgatgagttatagaagtgggattgaggttgtgttatatttttattggtatttgggaattattttggagattttttttttattttttatttttttgagatggagttttgttttgttgtttaggttggagtgtagtggtatgattttggtttattgtaatttttgttttttaggtttaagtaatttttatgttttagttttttgagtagttgggattataggtatgtgttattgtgtttagttaatttttgtattttttagtagagatggggttttattatattggttaggttggttttgaattttggattttaggtgatttatttgttttagttttttaaagtgttgggattataggtatgagttattgtgtttagttattttggagtttttttgtggtttttaggagatttttgaaggggtattagttatgattaaaaagttttatgttgttgtgatttttgagttttgggtagggagggaggttgtatttatataggaagtagtttttgttgtgatttagtgtgttggtttgttgtggtggatagggttgtatttttatttagtgttttgggagttgatttatgggaagggtaaggaattgtatttttagagaatatttttttagttagttaatttggtgataggtgagtgtgggaagggtataagtatagggtttttttttttttttttttagttttgtttttgtgtttgtttttgttgttttttgtttttttatgtttaagtttgtttgttttggtgtatttaggggatttggattggagagaaaaagttattttgtatggttagtttgtggttttgtttgatttgtgttttttgttgaggttttttagttgtgagatagttggttgagtttaagttttggggttagttttttttttagtttgttgtaaaggtagaaaggtatgtttaggtaggggttatttgttttgtttgtttatgttagattgtaggtatttgtttgttagatttttttggtttgtttagagggattttgatagttgagggtaatgtatttggtagtggagtattgtgtttgtgatagtttattttttttttggaattattttttataagtgtgattagtttaagttaggataggtatagggggatttaggattgttatttaggggtagtggtttggaatttaggtttaggtgatatgggagttaattttttgtttggagattttaggtgggtgtttgtagaggatattttatttgaggatttatggaaggggatattttttattttttatttggtttttgggttgtttttttttgatatttttttgttattttaggtagttttgatagttttatgtgattgggatttagaggtggtttttgtttttgttttagtgtttgtttataggtagtgttgtgtgggttttgaagtttgtttaagatggatttgataaggggagtttagtatatattagtgtaggtttggttagggggtgatgatggtagtttttgggtagatttagttggttttagggtaggaggggttttagagagaggttttaggtttttaggggtgtgaatttttggggtgaggtgggaagtgatgtgttgggtttttgtgtttttgtttgttggagttattattttggaaatattttagttttaggtggttgttagggatttatggggattagtgggtgttaatttttgggtgaagtttttggggtttgtatatagtatatagtgttgtggttttatggtttattttgttgtgtgaagtggtttagtttttgggagagtttttagttaggtaggtttgatggtaattgttaggttatggtgatttggaattgttgattaaagggagttagttttggtgggtggagggatttggtgggtagttattgtgatgttaggtatggggattgtgtgttatttaggtttgtgggtgttgagtttttgtgggagtagtgaagtgtttttgtggttgatgggttggttatttttgttttttttttgatgtgatagttgtgtttgggttttgggaaatttgttaggaggtttggtattggtttgttttattggagtggttttgttgagttgtgagttgtttgtttttttgaggtttttagtttattttaattttttatgtggatttggttatttattttagaagtgtttgttgggtgttgttgagtgttaggttttgtttgtttttttttttgtatgttggaggttttgggtattagttttgtagggtggtttggttttgggtttttagggtagagtatggtattttttgtttttagtttagtttttttttgttttatttttttgattttattttgggtatgggtttatttgtagtttttgtgaagggagatattgagttgttgttggtagaggaggggtggtttttgggtattgtttgttaatggttttttggtagttttgtgatagttgagttttgtttttagtttaatttgatttggttttttaaagtatgattgttggtagtttgaaaatttttaggataggaaataggagtggtgtagggaatgtaagatgattttagttttaagttattgggtggtttttagatttaggttgtttgttgtttttggtaggaatttaagttgttggttatttttagagtggtgttggtttggggtttttagtggtttttgtgtttgggtgagaggaattttggatggttattttgttttgagtgtgtgggtttttagaagtgttgggttagggggtatggagggttagaaagttttttttggagtgttggatttttttgttgatttttattttattttggtttggggttttagagaaggggtttaggtaggagtgttatttttttttaatggggatgtggttttagtttttgtttaggtgggtgtattgttttttttttggttttttttaggttgtttaaatgatttgtgatgaggtttgtgttatggttggggttttttgttttttttagtgttgtatttgggaattaggggttgggttttggaagttgaggatgtttttgaatgttatgtttgggtatttgttttggttaggtgaggtgtgttggggtagtggttgagatgggagtagtagtattgtttgttaggtttgagatgggttttgggtgagtgtggttattaggaagggttgggtagagtaggtgggtgggttgtttttggggttttgttttgtagattaatttgatttgtattttggggttggggtttttttttatagtttttttatgaattatggtttttgtttttattttaaattagattttagaagaggaataatgtttatgtaatttaagttagttggaagtgggttatatttaatttttgttattttttagtttgttaaggatttgattaatttaatttagagggatttggagggttgtttgtaaaatttattaataatagggaattttagttttgtagttatagggtttatagaggtgttgggttgttgggttattgttgggaggtgagttggtggtgtagatattatggaggtattggtagtggaagagttgtaagtgtatatagaggttggtattgaggggtggggaggaggaggtggtggattttttgttagtgttggtattatgttgtttttagtattagagatttaaggtgtggttgattttggttggggtgatgagttattggatagtagagtttttttggtagttgggggttaatgttttaattgttgggattttgtattatgttgttttttttttttgttttgtttggtttggtttggtttggtttttgagatggagttttattttgttatttaggttggagtgtggtggtttaattttggtttattgtaatttttgttttttgggtttaagtaatttttttgttttagttttttgaatagttgggattataggtatgtgttattatgtttggttaatttttgtatttttagtagagatggggttttgttatgttggttgggttggttttaaatttttgattttaggtgatttatttgttttggttttttaaagtgttgggattataggtatgagttattgtgtttagtttgtatttatgtttttttttttttttttttgagatggagttttgtttttgttgtttaggttggagtgtaaaggtgtgattttagtttattgtaatttttattttttgggtttaagtgatttttttgttttagttttttaagtagttgggattataggtttgtgttattatgtttggttaattttgtatttttagtatagatggggtgtttttatgttggttaggttggttttgaatttttgattttaggtgatttgtttgttttggttttttaaagtgttgggattataggtgtgagttattgtatttggtttatgttttttattattattatttaattttttaaggaaagtaatttaaattgtatattgtatttttttttttttttttgttttttgttgttagttttttgtattatttattgttaaataatatgaataggaaattgaaaggaaaattttaataattattggttgtagtattttttttgtgttttatttagtgtttgtttttttaggaatatgatatagggtttgatttaattatgaaaggtgtatatttttagagttttatattttttatagaatgaatgttgaattttgttttttttatttgaaattagattttaggtatggattttatgattattattataatggttttttagagtggatattgtattttgtagggaattattttttttttagttgttggtgtggatgtttttttttgatggtgtgggtttgggtttttgaagggtggtgttttgagtaaagatgttatagtagttatgtttatagttttgggtttggggttaggtggagattggttttaattttagagtttgttgttttaaaataaatttttttttttttttttttgagatggagttttgttttgttgtttaggttggagtgtagtggtgtgatttttgtttattgtaagttttgttttttgggtttatattatttttttgttttagtattttgtatagttgggattataggtatttgtttttatgtttggttaattttttgtatttttttagtagaggtggggttttattatgttagttaggatggttttaattttttgattttgtgatttatttgttttagtttttaaagtgttgggataaaataaatttttagggttgggagtggtggtttatatttgtaattttagtattttgagaggttgaggtgggtagattataaggttagaagattgagattatggtgaaattttgtttttattaaaaatataaaaaattagttgggtgtagtggtgggtgtttgtagttttagttatttgggaggttgaggtaggagaatggtatgaatttggaaggtggagtttgtagtgagttgagattgtgttagtgtattttagtttgggtgatagagtgagattttgttttataaataaataaataaataaataaataaataaatttttatatttatttgtattatttattattattattattaaatagggttttgttgtgttgtttaggttggagtgtagtggtgtgattatgattttttagttttgattttttagttttaattggttttttttttttagttttttgagtagttgggattataggtgtgtgttgtatgtttggttaattttttttttttttttttttttgagatagagttttattttgttgtttaggttggagtgttgtggtgtaattttggtttattgtaatttttggtttttggattaaagtaatttttttgttttagttttttgaatagttgtgattataggtatgtgttgttatatttggttaatttttgtatttttagtagggatggggttttattatgttggttaggttggttttaaatttttgattttgtgatttatttgttttggttttttaaagtgttgggattataggtgggagttattgtgtttggtatgtttggttaatttttaaaaaatttttgtagtagttgggtgtggtggtttatgtttgtaattttagtattttgggaggttaaggaggttgggagtttgagattagtttgattaatatggagaaattttgtttttattaaaattataaaattagttgggtatggtggtatatgtttgtaattttagttatttaggaggttgaggtaggagaattgtttgaatttaggaggtgggggttgtagtgagttgagattgtgttatggtattttagtttgggtaaagagagtgaaattttgttttaaaaaatttttgtttttgtttttgtagtgatagggttttgttttgttgttgtttaggttggtattgaatttttagttttaagtgatttttttgttttagttttttaaagtgttgggagtataggtgtgagttattgtgtttggtttttatttgttttggttgtttttttttgttttaggtaattatatatttttttaggtaattaagaaaagattgtgtatgatgagttttttttttggtatttttgggattgtttttaaaattagataagtgtttttattttgatattttattaagattttaatgaatagaatgttgtttgtttttagtttgttggtttttttgtgaaggtttagggtttttttgtttgaaaagttatttttttgttgaggtttttgatttttttttattatggtagttatgttgagggtttatagagttattttttttttattttttttttggttttttaagatgtatttgtatttttggagatgtttttttgtttttttgggttattttttttggttgttatttattttgttgatttattatttgtgtaatagttttttttggaatttttaggtttttgttatttattttttgtagtttttgttttgttttttttgttttagtttttttttttattatttttttatttgttggtttttatttttgtttatggtatatttttgtgttatattttgatggttggataaaggttgagtgaaatgtatttatttttttggtgattggggtgtttattaattagaagggatttaaggttggtgtagtttttttttgtattttggggtattgttttgtggtttttttttgttggagtttgtagttttttgtttttttttttttaaattttttgagatggagttttgttttgttgtttaggttggagtgtagtggtgagattttagtttattgtaatttttgttttttgggtttaattaatttttttgttttagttttttaagtagttgggattataggtgtttgttattatgtttggttaattttggtatttttagtagagatggggtttttttatattggttgggttggttttgaatttttgattttaggtgataggtttgtgttggttttttaaagtgttgagattatgggtatgagttattaggtttggttgttgagattatttttataagttattaggtttggttgtagttggtagtttttgattattggttttgttttatgtgatttgtgattttttttttggttttttggttttgttttgtttatttgtttattttttttatgtatgtggtttgtttatagggtatgtaatggggtttaattaggaaatggaaattgtttgagtatttatttatttatttatttatttatttatttatttattttttttaagataaggttttattttgttatgtaagttgaagtgtagtggtgtgattatagtttatggtagttttgaatttttgagtttaagtgattttttttttttagttttttaagtagtttggattataggtgtatattatatgtttgtttaatttttttttttatttttgtagagatagggttttgttttgttgtttaggttggttttgaatttttaattttaagtaatttttttgttttagttttttaaagtattggagttataggtatgtgttattatgttttgttaatttttgtattttttgtgtgtgtgtaaagataaggttttattatgttgtttaggttggttttgtatttttgggtttatgtgatttttttgtttgggttttttaaagtgttgggattataggtgggagttatagtgtttggtttatttgagtatttagaatagaaggatttaaaggtggggaattagttatatagatgatgggagaggtgaaggttagatagggaatagagaggtaattagtaggaaattaaagtggtgtgggtttatatagttttttaaaggtatggatgtaatgatttatttagaatgagaaaataaataatagtaaattataaattataagtagttgttaaatattataaatattattatatgtagaagagtattagttaattgttagttatatttttaaagttttattttttttatatttttggtattatttttttaatatgatgattttgtaatattgttttttattttgagaatagaaaattgattaggttggatatagtggtttgtgtttgtaattttagtattttgggaggttaaggtaggtggattatttgaggttaggagtttaagattggtttgggtagtgtggtgaaattttgtttttattaaaaatataaaaattagtagggtatggtggtatatatttgtagttttagttatttaggaggttgaggtgggaggattgtttgagtttaggaggttgaggttgtagtgagttgtgattatgttattgtattttagtttgggtgagagagtgagattatgttttaaaaaaaaaaaaaaaataataaaaaaaaatataggttgggtgtggtggtttatgtttgtaattttagtattgtgggaggttgagatgggtggattatttgaggttaggagtttgaaattagtttggttaatatggtgaaattttatttttattaaaaatataaaaaattagttaggtgtgatgatgtatgtttgtaattttagttatttgggaggttgaggtaggagaatggtttgaatttaggaggtagaggttgtagtgggttaagattgtgttattgtattttagtttgggtaatagagtgagattttattttaaaaataaataaataaataaagtgaatgaatttttttagttgattaaattttgtttttatttttggtagttgggatgtatataaaagtggtggttaatatggagttggtggtgttgttataattgttttgtttaagatatataggaattttggtaaattttgtttttttttttttttttaaatgtgatttttattaagaaagaagtaggaaaatgggggagatttttaattgtatatgaggtatttgtgtatgtatttttgattagagagatttttttgttttgattttatattgaaggaattgaattttttgtttataattttatttttggtgatgggagtaattttttatagatttgtttttggatttgtgtattttaaattttgtttttttttattgtgtatgtttttttggtgttaggtattgtaggatatgtttgtgttttgtgatttttgattttgtgtggtaggtggaattggaatggtgagtggagtgagtattgttggaatttgtttttatattgggatagtgagtagtaattgaattatatatggaaataaatgggaattatataaatataatttgattaaagttaaattaaatatttttttagtttaatttttttttagtaggagtttttatgtggtagtaagtttttgtttttattttatataagagaaaatgtgatgggtaggaatttaagattggaaatgaatggggatgttaattgattgtagggaaaatattttttattttgtaaattttataaaaaatgtttgattttgtggatatgtggttagggttttttttagtgttttgagagggaattatgtaggtagagggagggtttttagtattgtgggggtgatttggagattggtagtagggtgttattattatttttaggtggggatgagagggaggaagttttgtgattagagtttaggggttagagttatttgttgggagtttaaataaaggtgggattttggtaggagttggaattatatagaggattattttttttgttggagaagttgtttgaggtagaggaggtggagagtttttgtgtttttttttgtttttattttttaggttttttttaagttttttgttggttgaatttagtttaaagttagtaggtttggggatttggatatttgagttagtagaggttggtgttttttttatataaaggagggtataagaagtgggaggtatggagggggattaggttaggatttatataggatgtgtaaataggagtttttttttttttttattttaaatggtatttgtagttggttttatttttttgttgttagataggaagaggaattttgtttttggtattagttgtttttattgttttttattttatggaggttttttttttttttggtttttgtttgtaattattggtgatgttgatggattatattttttggggagtttggttatgaatatggttttttatttgttgtggattaaattgtgtttttttttttgaatttttgtgttgaagttttaatttttaatgtagttgtaattgaagatagggtttttagggaggtaattaaggttaaatgaagttatagggtaggattttaatttaataggattgatgtttttataagaagagggagagatattagagattttttttttttttttatttgtaaatagaggaaaaatgatggaggatatagtagggaggtgggtataagttaggaagaggggttttgttgggaattaattttgatggtattttgatttgggattttgggttttttaaattgagaaatatatgtttgttgtttaagttattttttttatagtaatttggatggtagtttgagtttattaaggtattgtttgtattagttagggttttttagggagatagttaataggagatggatggatggatggatggttagatagatagataagtggatagagagagagagagataggtagatatagatagataggtagataaatggttagatagataagtagatagagagatagagatagatagatataaataggtaaatagataggtagataaatggatagatagatgatagatagttaggtaggtagatagatatagataggtagatagatagatagatagatgataggttgggtttagtgatttttatttgtaataattagtatattggtaggttgaggttggtggattatttgaggttaggagtttgagattagtttggttaatagggtgaaattttatttttattaaaaatagaaaaattagttgggtgtggtggtgtatgtttgtaattttagttatttgggaggttgaggtatgagaattatttgaatttgggaggtggaggttgtagtgagttgagattatgttattgtattttagtttaggtgataaagtgagattttattttaaaaagaaaaaaaagatagatagatgaatggatagatagttagatagatgatagatggatgataggtagatagataattgataaatagatataaatgattgatggataggtagatatagatatattgattaggtagatgatagatggatagatagaagatagatggtggatgggtgggtagataggtagatagatagttagaaagatagatgatagatagataggaaggaatttattaggggaattggtttatattattgtggaggttaagatgtattatagaaggttgtttgtaagttggaggtttaggaaagttagtattgtggtttagtttaagtttgtaggttttaggattgggaagttgttgatgtaatttttagtttaaggttaaaggtttgagagtttggggaattgttggagaattgggagttttaagtttaagggtaggagaggaaggtattttatttttaggagaaagagggaatttattttttttttgtttttttgttgtttggtaatggaatggtgttatttatattgagggaggatttttattatttagtttattaatttatatgtttattttttttagaaatatttttatagatatatttagaagtgatgtgttattagttattttttaatttagttaaattgatatttgttgttagttattatataggtttagaagaattgtggttgtatggtgatggtttttattttgtttaaagaagttgaagatgaattgttggtataagttattgtttttttaggttttttttagttgtttatttttttaaaaatgtatttattgagtatttgttgtatgttaggtgttgtgataagtattggggtatagtagtgagtaaataaggatttttgttttttggagtttatatgtagtagaaggaaatagaattaatgaatttattagttttagaaattattaaaataggattaagagttgtggtgagaattaagataaggtgattgtatagaaagtgattgatggttgttttggaatgagtggtgaggggttatagagatgatgatagttgagttgagattgggaagataggaaggagttagtagtgtaaggattaggttggaagtaagtttggtgtattttaggaatagtaaggaggttagaggggttgtagtagagtaggtgaggaggaggagggagatgtaggttaaagaggagtttggggttagatggaggattttttttttaaagtttagttattttttttttaaaggagaatgtgttatttttaaaagttatatatgttagtatagtgtttggtttattatatgtttttagtaggtggtgagtatggttgtttttgttattattatattataattattaggaataatggagttattaggttttgtatttatagtaatgtgagggagttagtaagtttttttggggaatttatttttttttattaagtttataagagtttgataattaggttaatgtagtgagagttatagttgtttagtgtattggattttttagttatgggttaggatatttttattttagtagaaatttttaaggggattggggagtgtgttgtggatgtttttgggttatttagattttttggggagttttttttattgtagttgttgtagggagtttagttgtagtgatgaattgtggtttagttttgtttatgggaaaattttatatgggagatgggatggttttttgttggtttttttggttttaggttgtttttataagtgtagggatttttatttgggtgtgtgaatggggtttaggatgttttaagggtatgtggagatgggggttagttgttttttttgatgtttttgaattttttttttttgtttttttgtattttattgttttttggttttttttattttgggtgttttggaataatatgtaatttaatatataggttgattttattattttgttttgttttattttattttattttggaaataaaggttttgttatttagtttggagtgtagtggtgtaattgtaatttattgtagttttgaatttttgggtttaagtgatttttttgttttagttttttaaagtgttgggattataggtatgagttgttgtgtttggtttaggttggttttaaaagttttttattttttttgtattttgatgatatttattttttggagtaggtttttagttattggttttggatattttgtagttattattggttagttgtggtatgtgaagttgaggtttaggagaagggtagttttgtttaaggttatatggtttagtgttaatatttagattttagtgtttttattttttttttggttgtttttatttttagtgtatttttggaggtttaagggagttaaaggttaggttttggttagttaagaatttaaaaaagttgtttttgtgtttttttgttaatttattattttattattttttttgataatgaatttagtttgaattttagataaataaggattaatttttagtataagtatattttataatagatttgggatatatttatgtttaaaaatgatttattgtttgttggttttagtagtttatgtttataattttagtgttttgggaggttatagttggagaattgtttgagtttaggagtttaaggttatagtgagttatgattatgttattgagttttagtttgggtgaagtagtaagatttttatttttttaaaaaattgttgattgtttatttgaaatttaggtttaattgagtattttgtattttatatgagaattttatataggtgagatttagagttttaatgtttattggtaagtttttgtagggaggttttgtgggtttttggttggtattgatgttttgtgatgagtagggttatttggtaaggtggatgtttgttgtttatgtaggtagagtaaggttttgggtaggtatgagttgattttattttttttagtttgggagttagatattgttggtagtttgttgttaagagaggggttggttattaagagaggggtggtttttatgggttttttttggtttttggtttttttttagttttttttttattttaaatagaggttaatggtattgtattagaattagtgtgttgttttttttggttggtattttgtagttgggtagattgttttttttttataggagttggtggtgttttttttgttttatagggaggatggttgagatttttgattttgatatagggtgttgttttttttttgttttgagatagagttttggtttttttatttaggttggagtgtagtggtatgatgttggtttattgtagtttttattttttgggttttagtaatttttttgttttagttttttgagtagttgagattataggtgtgtattattattgagaataatgttttttatagtgtttatttttttgtaggagtaagtttttaaggtaaggaggttgttttttttatggatgaataaattgattttgatttatagttttatgtgttagttttgagggtggggaaaggttgttttgtgtttaggtagggggtgggggtaaggttaggagggtttggtgtttagtgtatttttttaggatataattttaggtagtagaggttaaggatagaggggaggagaagagggaggtggttattatttttttattttagttttttttggagataagtttgagtattttagttgtttattaagtttggagataagtttggaatttaaatttttgattttgatttagttttttatagtttttgtgagtaaattgagttttagaaaaagggagtgaagtttgtgtattttggatgtttttattttaggtttaaattgtttttattttaggtttaaattgtttttattttagtttaaattgtttttattttaggtttaaagtgtttttattttagtttaaagtgtttttattttaggtttaaagtgtttttattttaggtttaaagtgtttttattttaggtttaaattgtttttattttagtttaaattgtttttattttagtttaaattatttttaatataggtttaaattatttttaatttaggtttaaagtatttttattttaggtttaaagtatttttattttaggtttaaagtgtttgtaatttaggtttaaagtgtttttattttagtttaaattgttttattttaggtttaaattgtttttattttaggtttaaattatttttattttaggtttaaattgtttttattttaggtttaaagtgggaaggagttatagggaaataaatgggggaggtatggatgattaggatgagggtttttatgatttatttttttttaggggttattttaagagttttttaaatttttattattttttaatagagatggggttttgttgtgttgtttaggttgatttttaatttttagttttaagttatttttttattttagttttttaaattgttgaggttataggtgtgagttattgtatttggttttttttaggagttttaagaaaaaaaatgggaatagatttgtgtgtgtgtgtgtgtgtgtgtgtgtgtgtgtgtgtgtgtgtgttttgagaaagagttttgttttgttatttaggttggagtgtaatggtatgattttggtttattgtaatttttgttttttgggtttaagtgttttttttgttttagttttttgagtagttgggattataaatatgtaggttgattttgtatttttattagagatggggttttattatgttggttaggttgattttgaattttggattttagatgatttgtttgttttggttttttaaagtgttgggattataggtttgagttattgtgtttggttaggaatagatttttttttgtagatgatttttgttattattgaaaatggatgtttatgtataattgaattgttataatgttttattttaaaaagtttttttttgagaaaatgtgatttttgatagaggagagattgtttaggttttatttattgttagtataaaggtagagtaggggtgtggtggtgttatttttttttgagatagttttatttttgttttgtttaggggtttagaagtttggtttatttgagtttatagaggggtttggagtggttgttttatattataggtggggtttgtaaggatttgaaatgatttttgagaaggtgggtgtggtgggtgtattttaattattaaagtaataataatgatatattaaatagtgtttgtttagattttgagtgtttgtttaaatatttttattttgtgatttgttagattttagtataataatttaggtaaaagaaaaaatagttgggtgtggtggtttgtgtttgtaattttagtgtgaggttaaggtaggaggattgtttgagattaggagtttgagattagtttgggttatttgagattttatttttgaaaataaataaattaataaaagatttttatgttttatgttttttttatatttaggttttttaaattatatgtattggggaaagtttattaagagaagtttttggttgggtgtggtggtttatgtttgtaattttagtattttgggaggttaaggtgggaggattataaggttaggagtttgagattagtttggttaatatggtgaaattttatttttattaaaaatataaaaattagttgggtgtggtagtgtatgtttgtaattttagttatgtaggaggttgaggtaggagaattatttgaatttgggaggtagaggttgtagtgagttaagttggtgttattgtattttagtttgggtgatagaaaaagattttatttttaaataaataaataaagggagagaagtttttgggtttttagatatatgggttagtgtttatttttgtaaagttgttgtgtttaaagaggggttgtatttggtggaattggggtaaaagagtagggagggtattgggtagttgatttggtttttattattggaaaggggttgtgttgttggtgttttgagttggttttataaggaagatattgtatagggtgttttaagtttgttttttttgtttaggtttatttttttttttttaggattagggagttttgtttgttttttgtttttggtatttgttttttggtttgtgagtattgtatttttttttgtttggaatgttggtttatggtgggtttttggatttttgttttttgttgttttttgttatattttgttaaagtgtgttttatttatttattgttattattttttgaaatagagttttgttttgttgtttaggttggagtgtaatggtgtgattttggtttattgtaatttttgttttttgggtttaagtgatttttttgttttggttttttgagtagttgggattataggtgaatgttattatgtttggttaatttttgtatttttagtagagatggggtttttttatgttggttaggttggttttgaattgattttgggtgattggtttatgttagttttttaaattgttgggattataggtgtgagttattatgtttggttaattattataatattgatattataataatattatagttagataatggtgattaatgtttgtaatttgaatattttgggaggttgaggtaggtagattatttgaggttagtttgagattagtttggttaatgtggtgaaattttgtttttattgaatatataaaaattagttggagtgtgatggtaggtgtttgtaattttagttatttgggaggtggaggttgtggtgaattgagattgtgttattgtagtttaatttgggtgatagagtaagattttattttaaaagtagtaataataataataataataataatattatttattgagttttaattttgtgttaggtattgtgttagtatttgtgttatgtgattttattgatttggaataatttatgagtaagtattatttttgtttttaaggaagttgagatttaggaaatggaagttattttttagggtttatagtaagggtttggtgaggtttgtgtttaaattttgattatttgattttaggtttttttgttttttttgttttttaaaaatttaaatatttttatttgggatgattttagatagttagattttaattgttttttttttttttgagtatgttttattttaaaattatataaagataatttattttttaattggagttatggaattgttagatgttttggagatttttttagttatttttttgttggatttagatataggtttgaataattaggtttaaggagttgaattggagttgtttgtggttagaggtttttttttgggaatagtagtggtggtagtggttgtgttgagtttggtaatttgtttaagagtaggggatgtttaggttgtgtttgttttttttttatgaatggtttgttttgtgttttttttgtgttaagggttgttaggtattagatgtttattttaggaaattagaaaaataaatagtgtaaataaaataaaaattttatttaagaaatttgagatagatgttgttttttttattgtttttttatttttatgttgggtttggagagagtgggttagtatgttttttatggataagaggttttggggtatttaatttggatggaattttttttattttttttttgtttggtgttagggggtagaaggtaggggtggtgtttatttggtttagggaggaggatagggtagtttttgttgttggtattttttgtagagatgttttagttagaagtgattttatttttaggaatgtgtgttttgttttttgttgggtggtttttttttattttttattgtttttatagtggggtgtgttagatttatgggtagagttttggtttatttttagttttggatagtagaatgttttagtagtgtattgatggtgtgtgtgtggggatgtgtggaataggggatagtgattttgtgtgtgttatatgtagtgtggtttttagttgggtgtgtgaagggggtgtttatggttattgtggaagtgagtttagttggggttggagggtttaggtttattgtatgttatttagtagttttgggagtggggtttatttttttttttgtttttttttttttttggttttgggtagtttattggagttgtattttgggttattttttttggttttaaggaggttgttatttttgggaggtagatgttggtttttttatttttgttttttggagatttgtgttgaggtttgtttttttgtttggagggattggttaggaatttttgggtttttttggtggggtttttgttgtttagtagtgagtagagtgagtgggtattaagaggaggatgttgggtgaggttatggatatggttggggtaggttgggggtgttggaggtgaattttgtagttgtgtgattttgggtagtttgtttagttttgggttttgtttttttttttatgaaatggggtgggagtatttgtttgttggggttgtgggttgggtgaattggagttaaggtatagtttatagtttgttgttagatttttgtaagtagaagtgggtgtttttgtttagtgttttttggttttttttttaaggtttagttttgtttttattttttttatgaagtttttttggttattttaggagttatgatttatattttttttggagttttgtgttatatgtattttttatggtgttgttttttttggaggatgggtttaattaaaattggggtttatttgggggttttttttagtattagagaagtttaggtttagtagagatgggtattttgttaatattagttttgtgaaggatatattgtgtttattttgttgttagttgttgagtttggtgttttgtagttatggaatatgtgtataggtttgggttgttggatatgaaggttagatgggtagtttattttgtttttgttttgagtttttagaaataagttggttgtatttatttttatttggttatagtttaggagtggggttgtggaatggatggaaggaaggatgagtgggtgggtgggggggtgggtgggtgggtggatggatggatggatgatgggtggatgggttgatggatgggtggattaggtggataggtgaatggattggtgggtgggtgggtgggtgaagggttgaataggtgggttgggtggatgggtggatggatgtgtggaggggtggtggggtggatggggtttatgggtgaatggatggatggatgggtgaatggagtaaatgagtgggtggatggatggatggatgttgtaagagtttttttggagggttttagggaggaattggtatttttgattagtagttagtatggtgattagatatagggaggtgtttgggtttgtttgattttttattttattgttggtgggattgggttggttatgtgtttttgaagttttttgaagggtggttgtatggtattgtttaggggatatttttagagtgttgtgttttatagtaatagggtggttgtttgtgtttttagggttgttttttttggtagttttttgggtttgtttggtttagtattttagtaaatttttttgagttaggatttgtttgttatgagtttttttaataagtagttttaggttaaggtttgtgtgtgggtagagggagtgtatgttgtgggaggttgtattaatttgaggttttgtttttgtttttttttggggtaaaaggtaaaaatagtttgttttattttatttttaaatttagtttggttgtatttagttttgggagtgaagggggttgggttaggattgtttgtgagttgtagattttggtgtagggaaattttgatttataagatgggtggatatggaggaaggaggagattttgtttagtagagatatgtttgggtgtagtttagtttggagtttgatggatgtgggtttatttgtgtgtaatttttatttattgtgtggttatagggaagtgatattttgtggagatttagattttttatttgtaaaataggggtagtagggtttgggggaggatgtgtgtgaaggtttggtttagggtttttttagtagttagatagtagtggttgttatttttttagtgtttagggttatttgggggagtagggtttttgtttttagatgggttttgtttttggttttggaatttatagtaggagtaaaggtgaggatatttttggtgttaattatttatttggagggagagtgttagtggttttgtgtgatttttgttttttgtttttgtttttaggaggtatgtggatttttagtggttggttttggaggtttggtgattttagtggtttaggtaggtggtttgttttgttttggttttatttagtttatgggtgtgtttgtgttggggtttttttattttggtttgggatttgtttttttatttggtttttttggatgagtggggttatttgtttattttttagggagatgtagtttttgatggttttggatttaggtggtttttaggtttgttgatgttgttttgttggagatgatttttgtgggggtaggggtagttatttttaggtttagggagtaagtttgtgtgtgtgggatagaggagagaataggagatagatagggttggatgatttggtttgagatgttgaggggatagatgtgttatggataggtggttttggttgtgagttttttggtgttggtttagtatttgtgggttttttgtaattttgtaggatggaagatgttttaggatagagtagatatgtttggtgttatttaggaggaaataagtgggtttttggtagtggttattgtgttattttttgtgttttttttatgtgtttggaaattttttatattaattagtagggaagggaaatagatgtatttattagagttttggggttggttgtttaggatatgagttatagtttataggtttgaagggattttattaatattgggtgtagtttgggtaagggagtgggatagagaggttagggttttgtttttagtttttgttttttagggttgagtttgtgtgttattttttttttattgggtgtttttgattttttttgtttgattttagtgtggttatgttagtgtttttgtttttgggagtttatgttgtttttggttgttatttttagtggttaggttgggataggtgtttatttagtggtttttttatttggagaggatgatgggttatagtaatgaatggatttattttttttaggagatgaggagttttgagaagagtagagatggtgtggttatttgtgtatatgtgttgggggttaattgggtgttagatttttggttgttattatggtggtagataggtagggattgtgtttttatgaattagttattttagaggagataaagttattaaaggatatggatttggagttaaatttatataaatagagtgtttgtggattagggttgtttttagaataaggtgagatagttgttttgttaggataaggtgtttatgggggtaagggtatgtgtttatttggagttgttatttttatgttttagattagttttgtttaatagaattttttgtgatggtgggtttgttttatatatttgtattttgttattttgtatggtagttgtttagttgtttgggtttattgtatatttaaagtataaatgtttatgtttattttatttatttatttatttgtatagaattatttatttattttaaatggatttttatttatatttatgtgtggttagtggttatgaaattgaatagttttagattatattggtatttgagattttagaattttagatttaaagtttgtttttgattttgagtttgtttttgtggggatagtatagatgttttttaagtttgttttttagaggtggatgtagtgtttgtggattgtgtattattaggtttggatagtggagagggtggttttttatagggagtgggagtggaggggatgttgtgtttatattgagtgtatgtgaggttttttgtagtataggatgggattgtatgtgggaagaggggggtgatgttttggttggaggtttttgggtagttgtatgatttagtgttgtggttaagaggggttttgtttattgtagttatgttgggtattaattattggatagtttagttgttgttgtgtttttggggagtttttttttggttttgtatttgatttgtttttttattttttttttttttattggttagtttttggtggaatgggtggggagggttttttagtttttgtgggggttgtattttgggaatttggtattttgggttgtatggatatagttttttttggtggttgtttttttttgtttagattggttggttttgtgttgttagtatttggtagttatgattatagtttagtttggaagtttaaggtataatttgttgaattttaaagttgtaagttggtgatttgggtttgtgtgggattgtttgttgatatatggggttttttttttgtgggtttttgtgggttttggtttgagatattttttttttatttttttggtttttttttttttttttgttttttttttgttaagattttggtttaggtaggagtttatttttagatgttttagtatttttggtttttttatttgatattttttagatgattgtttgttattttatttttttagtttagtttttttgtagatttatatttggttaattttttatgtttgggatttttgttttttttagaaggatgaaggttttttttgaggttgtgtttgggattgggttagggatgatatttttggtaaaagtttaaatgatattatgattaatgttttggttagtttatatattttttttttttttaaaaaaaaaatggaatttttagagttataaaataaaaatgtaaagaataaggtaataaaatatttgtgtatttattattttgtttaagaagtgagatattgtaggtgtagttgtagttttgggtgattttttttattttagttttatttttgttgtggtgtttgtttttttggattgggatttggttttgggtaggtatatttgtgttgggtagtggtgtgtttgagaagtttaggtttttttttttttttttttgagatagagttttgttttattgtttaggttggagtgtagtggtattattttggtttattgtaatttttgttttttgggtttaagtgatttttttgttttagtttttttagtagttaggattataggtatttgttattatgtttggttaattttttttgtatttttagtagatatagggttttattatgttggttaggttggttttatatttttgattttaggtgatttatttgttttggttttttaaagtgttgggattataggtgtgagttattgtatttggtttggtttttttttgtatatggttattagtattgtgtgattgagtagtttaggtttgtttttttttgaatgttgttattagtattatatttttggtgttttattggagttagtggttgttttgtttgtgtttataatgtgatggtgtggagatttatttgtgtagatttatgaagttttggtttatttattttggtagttagtgagtgtttttttgtgtggggaggtagagtttgtttgttttgtggtttattggtgatattgttgaaggttttttttgttattagtgttgttgggaatgtgtgtttttttaggtggatttggttgggttgtggagatgtgttttttagtttttttagatgttattattatgtttttttgagtggttttttggtaggtttttttatgtttgtttattttttgtgttttaggtagttgtttttttgattgagtgtttagtggatttttgttttgttttttatggtgtatggagtattttattttagtggtgtttgagtttttttttttttggtttttagattttggttgggatttttggagttaatttttttgtttgatattttgtgttgttaggttttgtttttttattttttaatatttttggggtgtgtggttttttttttagtgtttttattattttttttgttttaggttgaattgtgttttttataaatttatgtttattaaaaattttagaatgtgatttgggagttggagatggggtttttgtagatgtaagtagttaaggattttgagatgaggttattttggattagggtgggttttaaatttaataattggtgtttttaaaagaagtagagaggttatagatatattggggagagttatgtgaaggtaggagtagatgatggagtgatgtagttttaggttagggagtgtttgggaagaggtaaggaaggattttttttttattttattttagagtttttttagggagtgtggttttgttgatattttgattttggatttttggtttttagtatgggagagaatttgtttttatttttttaagttttatagttgtggtttattatggtagttataggatattgatgtattttttatttggttgttgtggatggatgattttgtttgtaggaagttttttttaagtattgtaggtgtttttgtttttataggggatgtttgtataagtaggtgtgaaaaaagggttttgtgggggtaaggtttgggttggtgtttgttgtttttttttattttatgttagtttttatgttttttttggtaggagtgtttggttttatttggtgaattagagttaaatttttttgataattggttgttatttatttaattgttattatttttaggagatagaaaatgttagaagggtggggtttgtgtagtgtttttttgttatttttttagggtattgtgttatgttgttttaatgtatagagtagttgtttaaagtgtgttggatgaataggtgttttatgtttagttatgtagataaaagtgtgttatgtggagggagttggttgtggaagagattattagtattttggttgtttgaggattttgtttttgggtttttgtaggtatttttagtttattatttttttttttatttatagttatttattttttttttatttttttgatattagttttgttatttatttaggtttgtaagtaggaaattttagagttgattttgatttttgtttttttagtatttttaggttttaataggttgttaagattttattaatttgttttttgtatattgatttttggataggttgttttggttatggttatgttttggttgggtttttattatttttttttggattagtaggtgttattttttttatttttgttttgttgtggtttttttttttttatggttaatatttagaggatgattattatttttttttttgtgtgttggggattgggtgataggatttttttatttgattatttttattagatttgggttgggtttttttatttatagagtttttagtttttgtttttaaagttttgagggtggatttgtgttgttgtttagtttggttttgatattgttttttagtttggagttttttgtttttgtgtttttggttttgagtgtttgggttttttttggatgggttgttatttgttttttggaaagtagggtttttatgtttttggattttttagttgatttagtgattttgggttattttgttatattttttttattagtttggttttggttatttttgtgttttttatagttttggattagagttatggtgggatgtttttttggtgtgtggtaggtagttaggaaatattgttggattgattttgataggagatgtttgggagaattgtttaaaaaattagtttaaaatgtaaatattggtttttttttgtgttggttaaagagtagtatttttttgtttgttttttgggtaagaaattgatggtgaatgtaatgtttttagggaggagaagaaggtgataaaaagggtttgtataatggggtatatgttaggtatttgtgattatttaagtttaaattataatataaatgtgaaattttttgttttggtagtttttttatattgtaagtgtttattgttatatgtggttgttatattgattatggtagatatagaatattgatattattgtggagagttttatgggggggtgttggtttagattatttttatgttggatttataaatttattgtttatttagtgaatggttattgggtatttattgagtaagtaggatgaaagatatttgtttttgggggagttttttgttggttgtagagaagtttaaatttaggggatttggggtaaattttgtaagggtttttggtttttgtatttttagattttttttgttttgtaggggtagttgggggttttttttaggaatggagtgttagttttagtttttgttaggttatagtttagatggttggttgagtatgagtatgtgagagtggaattgggtttaattgggttgtttttttttgttgttttggtttttttttatgttgatttggaaggatttttaaagtaataggtttgtttaggtggtttgtattagtaaattttgtagtggttttaagggtagagatagttggattgtatttatttaggaatagttaaagtttgaggtataataaaaagtggagaaagattttagagaggaatgtagttggttttagtttgggaatttgttttgtttgggaggttgtaggtgggttaggttggggttagtttggagggttttggttggttttgttggtaggtatagtagtagggttagtaggagggagtttaggatggagtttttttatttttaatttagggaagtaaattttagtggttgagtttgaggatgagtaggaaatgaatggaaaagtttttttttttttttttttttttttaggtagggtttttttttgttttttaggttggagtgtagtggtataattatagtttattgtagttttaatttgttaggtttaagggatttttttgttttagttttttaagtagttgggattatagttgtgtgttattatgattggttaatttttaaaagaaatgtttttaggttaggtatggtgatttatgtttgtaattttagtatttttggagttgaggtgggaggattatttgagtttaggtgttttagattagtttgggtaatatgatgagattttgttttgattaaaaatataaaaagttagttgggtgtggtggtatagttttgtagttttagttatttgggaagttgaggttgtagtgagttgtgattatgttattgttttttagtttgggtaaagggagtaaggttttgttttaaaaaaaaaaattttttttttttttgaggtggagttttgttttgttgtttaggttggagtgtagtggtatgattttggtttattgtaatttttgttttttaggtttaagtgatttttttgttttagttttttaagtagttgggattataggtatgagttattgtgtttggattttttttttttttttttttttttgtagagatgggatttttttatgttgtttaggttggttttgaatttttggttttaagtgatttttttattttggttttttaaagtgttggaattataggtgtgagttattatatttagtaggaaaagttattttttaaagtgagaggttgtgtgttttttatagtttggtgtttattagtatggaggatttattggaatgtgtgttaggtgaggggatatggaagatggtagtaaatttgagtttagagtattagaaagtatgtttttagttaaagatgtgttttttttatttttgtgtagtatttttttttagtgtgtatttttggagtaaggtggggttgattttatgaagatttttttttgaaggtttttgttgtttatattagtgttatttggattgtttgtttttttttttggatggttggattagttttagggttttttggtttggtgtggggagtatagtttattttggggaatgtttggtatgtgttttttttttattgggtattaggggatgaagttgtgttttgtggaaggggatagaggtgttggtgtttaggatggtgtatttggggtggttgaattggatttggtttttattgggtttttgtggagtttagattgttgtgagaaggggtggggaaaggtaggtgatttgtattttttatttttgttttatatgggaataggggtttattttgtatatatatttagtttggagtatgaatttttatgaagaggaaaatttttattaggttttgatgttaggattgtttgtgagggttgggttgtgttttggggtaaggataggagtggagggggtaattagggaaggttttttaatggaggaggtatttgatagtattttgaaaaagaagtagtttttaggttaagttagagattgaagaatgattatttaattttttttttttttttttgagatggaattttgtgttgttgtttaggttggagtgtagtggtgtgatttaggtttattgtaatttttattttttaggtttaagtaatttttttgttttagttttttgaatagttgggattataggtatgtgttattatgtttagttaatttttgtatttttagtagagatggggttttattatgttggttaggttggtttggaatttttgattttgtgatttatttgttttggttttttaaagtgttgggattataggtatgagttattgtatttggttatgattatttaatttttttttataagatgttttttggttgatgtaaagtaggttgagtgagtgtgatattttttttttgtttgtgggttttggtttttttagagtttggttagtgttattggagataaagtggtttttgttttttttttttgttttgttaggtttagtttgtgttgttgagttttattttgtaattaagaggagttgtgaattagtgatgttgatgttgtagaaaagtggttaggggtttatggggggtgaaggatagggatgttgttttgagaattgtttggaaggggtttttgggtaatagtgtttattttagggtgtgggtaggttggggtggttgggagttgggtttataggttggtataattagagttttttaaagttgtgggtttgagggttttgtttttttgggatagtaatttttggtttaatttgggaaaaggtgggttaaattaagtttggtttttttattgtaggattatttagtgtgtttagtatgtaaatgtgtttttgaatttaagataggattatagaaatttttttagtgtttttttggagggagggattgtgggggatttattgtaggggtttgggtttgtattggtttggtgaagtgtttttttagtgtttatattatgtgtggtgagaggttggtttttgttttttttattttttgttggttttattttattatttttgtatttgttttttagttggtttatgattaatttttgtttttttagagttaattggtgttgttaggttttttattttaagtgattttttgtttgggttaaaatgtttggatttttaggtatggaggggagatggattttaggttaaattatgttgggtaaaattgagggttaaggttgtgtttagtaagtgttttagttttggttgttaaatttatagtgtgtatagtgtgtaggaggtggttgggtgaatgaatttagttatagtttggttttttatttggggttgtttttaagtttttattgttagttaggttgggttagagttttgtggggtttttttgggtttttttgttttatagtaggagtttgtatggagagttttgagtgaggttaatgggtttttttttttttttttttttttttttttaatttgagatagggttttattttttttatttagttagggtgtagtagtgtaattatagtttatagtagttttgaatttttggttttaagtaatttttttgttgtagttttttaaagtgttgagattataggtatgtgttattttgtttagttggggtttttgttttttatttttttttttgtttttaaatttaatataaagaaagatattatatttataattagaaaaattaataaggaatattattttaaaattggaaaagggattaaagaaataaattaagaaatttttgtgatttttgtttattggagttagtggttgttagtggttggtttaatataatgttttaggaagaaatagaataatagaaagtaattttagtgagttgagttttggttttgtttgtggtgttgtattagttttttgtagttgttgtaatgagtggttataagttggttgggttataataatgtttagttatttttttatagttttgtaggttatatatttgagattagggttattaggttgaaattagggtgtttattgggtatagttttttggaggttttagggtaggggtttttagttttgtgtgttttattaggaattggtttgtatagtaggaggtgagtgattggtaagtgagtgaagttttatttgtatttatagttattttttattgtttgtattattgtttaagttttgttttttgtttgattagttatggtattggatttttataggagagtgaattgtattgtgaatggtatatgtgagggatttaggttgtgtgttttttatgagaatttgatgtttgatgatttgttattgttttttattattattagatgggattgtttggttgtaggaaaataagtttagggttttaattgattttatattatggtgagttgtataattattttattatatattataataataatagaaataaagtgtataattaatataatgtgtttgtggttgggtgtagtggtttatatttgtaattttagagtgaaattttgttttaaaaaataaaaaataaaggttaggtatagtggtttatgtttgtaattttagtattttgggaggttaaggttggtggattatgaggttaggagtttaagattagtttggttaatatggtgaaattttgtttttattaaaaatataaaaattagttggatatggtggtaggtgtttgtagttttagttttttgggaggttgaggtagaagaattgtttgaatttaggtggtggaggttgtagtgaattgagatagtgttattgtattttagtttgggtggtagagtgagattttgttttaataaaataaaataaaataaaataataaatataatatatttgaattattttaaaattatttttttattttttggtttgtggaaaaattgttttttttgaaattgattttaggtgttaaaaaggttgggggttattgtttttattgtttgtttttttgagtttttggtggttgtgggtgttttttggtttgtggttgtatggtttttatttttaatattagtatttatagatttttttgggttttatttttatttggttatttttgtttgtgttaaatttttttttgtttttgttttgtatgagtattgagattgtttttagggattatttagattatttagggtgtttttgttatagtaagatttgtaattgaattatagatgtaaaaatttttgttttaaataaggttttatttgtaggtttagggattaggatatgttatttttggggttattatttagtttttttttgtgattatgatttttttttttttttttagttttttattttggttgagatgttgtttttattttttttattgtttggttgtttgtggggttgttttttaggttttttgggaggaggtggttgtttgatgttttttagaaggttgggaatggttttttttattttttaggaagatgttttttttgttaaggagattgtatttggggttttattttaggtagagagtggatgggattgtggtttgaagtggtattttagggtttttggttttgttatttagttgagggttgtgtatgggttttatttggttataggtaatttatttggttttgtggggtagggattgtaaatttagaggtttgtggggtgtgttgaggtagaggggtgtaaatattgtaaatttgttgggggttttggggagtagtatagattgaaaagtgttttgtttgaagagtagaattgttttatattagttttgtgtggttaggtaggaaggtttttgtggtgtggttatgtgtttttttttttttaatagaagttgatagtttggagtttttagagagattgtttgagtttttagttttggtataaatatatattttttttaaataggtttgggttaatagaattagtttttgtgttttgggtttgaatgaatttttgaggtgaagtttaaagatagagaggatgtttttgatttttattttagggatttatattgtaaatttttatttgttttgttgagtttttggttttagtatggattttgattatgtgttggtggggattttttaggtaagtaagtagtttttgaggattttggatgaatagtggggaatagtattgattttttagtggggttttgagtttttggagaggaagatttgtttttttttaggggatggttagagatttattgatttatgtgtgtgtggtaggaattttttaggaagtttttgttttgtttgttttttttgtttgggtggggatggtaattgtttttgttattgtagattaatgggatggaggggggtgattttttagggttttttttgggtaggtgttttggaatttttttttagtatgttggtttggggtatggttgttttttttgtttagttatgttggggtatagggtgaagaagggttggggttagtttaggatagaggaaggtgaggtaggtatgtaggaattgggttttttaaatttttaagtttaaggaaattgtagtattgtgggatagggaaaatgaaagattttggaagttgttaggaatttgattttgtgagttggtttttaagagtttaagttaagtatttttaagtggatattaaaaaggagtagtaagttttggggtggtgggggttggaggaggtggagagaggaggttgttggaagttgtatttgggatttttgtagttattgattagattgggtggttgggattttgggatttttgtaggtagatttggtggtttgttggattttttggggtttattttgggtttttttttttgttttttatttttggattttttttttttgttttttttttttttttgttttgaagagataatgttattttagtttggagtataaatatatgattagtatatggaaatgtggtaatttggatgtatttgtgattgtaatagattgaagaaattagattagataaagagtgtttttagaggaggaggaggaggaggaggaggttgagagagggagggtgatgggggtgagaaaggggaggttgtttttgagtgggatgttgggatttttgttgttgttaaatatatttgtaggaatggagagggattggattttaggtatgtagatagttttttttttattggttgttttttattgttttggatttggggttttatttatgtttgggggaataagtatgtaaagggtgtttttgtttattttttatagaaatattttttttttttttgatggttttaagtttgtgggatgaattttgttttagaagttaagtttttttgagtttggtttttatttaaatttggttttttttttttttggttattttttttttattttttagtgtgttatttttgtatgttatggttattgttaatgttgaggttgttggtgttgaaattttgggagggtgtgggggatttgtttttttggtttgggtttggggtggtggtgtttggatttggttggtggttggtttgtttattgtgtggtttgttttttgtttttagttaaagtttgtttttaaggttgttttggttttttatttaaaatagtatttttgtgtttttttggtagttgattatagagggggaagtttttggtgtttagaggagtttggtgtgtgtgtgtatgtgtgtgtgtatgtgtgtgtgtgtgtttatttatgttggtagtttttttgttgtaggtatagatttattagggtgtgaataggtaaatgaagagaaagggggtttttttgtttttagtttattttagttttttaggtttttttttttaggtttagtttttttggtttttttatttatatgtggtgttgtggttgttattttatgtggttagtgttgttattggtaattagtagtgatgatagtttttgttgtttatgttgttttttgagtttagtgttgggagatatggggtggttgagttaagttttaggttttgggtattttgaagtgatttatgggttatggagtgggaggttgttaagagtgttaatttttatgtgttttgggttttggtttgttggttgttattatgtgtgtgttggggggtttttgagaggtttgagagagggaggtttattttggtggtttttttttaggatgtgtggttttttttattattgtttttagggttatatttttttttttttttttttttgagatggagtttggttttgttgtttaggttggagtgtagtggtgtgattttagtttattgtaagttttgtttttttagtttatgttatttttttgttttagttttttaagtagttgggattataggtgtttgttatatttttttgtatttttagtagagatggggttttattgtgttaattaggatggttttgattttttgattttgtgatttgtttgttttagttttttaaagtgttgggattataggtgtgagttatggtgtttggttttagggttatattttgattgttatgttgggattggtggagtgggtgtgtgttgtgttgttgagtatatttagttgggtatagtaggtggattttaggagggggttaggggagatggtagaaggtttgggtggtagtgaaattgtattttatttgtttgagtttgggggtttaggtttgttgggatgggtgggtgtggagtttagtgttttgttttttgtttagtaggagttgtagggtagggagtgttgagagggatttttgttaggtttgtatagtggagttgtttttggagtgattattttattaggtagtttgggtagattatagtgggttttttgttttttgggttattagttttaggaggatgttattttatttgtttggttggtaggggttttggggagttttgggtttggtttttattttatagatgatttagttgaggtttagatgggtgattagtaggggatttgagagttgagtagagaggtgtgggtttgggggtggtgttttttggggagttggaagtgatggtatttttttaggtttataaaatatgggttttttatgaattgaataaaatattttttgaaagtagttagtgttgtgttttagagattattttgatttttgttgtttttggttgaggatagtatagttagggatgaagtggggatttttttttgggttgtgttttgatgaaagatgttttttataaaattttatttggatgtgtttttatgtaagaaaatgtatatttttagaaatttagttgtaaattggttgttttttgaatgaatatgatagttttggagttgttttttttaatgaggtttttgttttgggtaaattttagtgttggtttttaattgttattgaatttttgtatagtttttggggaagtgattttttttttgtttttgttgggtggttttgagtaagttatttggtagttttgggttgtagttttgttatttgtaaggtgaggggtgggagtggtatggtttttaggtagtgtttttattttttgtgggtttttgtgtgtgttttgagttttgtgggtgtttttttttttattgaggggttttttttttttgtagggtatggtttatgttgtgttgttaggttgtaagttattgtgagagttgttttgatttttaagtatgttttggtttgaggaggagttatggggaggatgttgtgtttgtgtgatagaggtttgtttggtagatgttggtttgttgatttttagatgtggttgtgggtgttttatgttttattgggttggtgtgtgaggtgtgtttagtttaggttgttttatagttgtttaggaagggtttgtgggagggggtggttttattttggtgagtttatggtggtttgttagttttagggaaggtttaggagttttaagatttgtttttttgttttttttttggtagtgtttggttttggtttggtttgtgaatgggggtttgggtatttttttgttttttttgggggttgtggtttttttttgggaaggtgttggagggtttgttagtagggttggtatgagttatggagtggtgattggttgttgaggtatggaaggttattttttttagttaagggttggagttttttttttgttttggaatggttttgtggtttttataaattaagtagttttattttgttttaagagtttgtattttagtagggagagagtttttaagaagggaattttttattggggagttttgttgggttgggaggttaggaataggttatgagggagggttgtaggtaggggaagtggttgtttgtgtatggttatgaatgtaggtttggggttttggagggggtttggttatgttgttgttggatgtttgtttttattagggtttatttgatgtagtatggtatagggtaaagtttagttttttttatggggtttttgggttattagtgggtggggaattgaggttttttggagggtggtgttttagtttttattttttttttttgttttttgttgtgttgtttttgatggtttttgttattttttgggagtttttatttttggatgtttggtgtttgtttggttttaatttttttagttttgtttttttatttttgaggtgagaggtttggtttgatgtgttttgtatttgttttttgtttagttttgtgggaattttggtttttgtagtggttttttggggttgttattattaagtgttataaattgggtggtttaaaatattagatatttttttttttgttgttttggaggttagaagtttgaaattatggtattagtaggtttggttttttttggaggttttgagggggagtttgttttttgtttttggtagtttttggtggtttttgaaatttttggtgttttttggtttgtggttatattatttgatttttgtttttgttgttatggggtttttttttgtgttttaaatttttttttgtttgttttttatatggatagttttttttggatttagggtttattgggtaatttaaaatggttttattttaagatttttaattttataatgtttgtaaagattttttttttaaataggttatgtttataggttttggggtggatgtaaattttaggggttattttttatttttttgttgtttttgtgtgtttggatgtatagtatggttttatgttttagattttttgttggatttttttggttttttggggtggtttttggttttttttatttgtttttgtgtttttggtgaggtgttggggttgggtttagtttttgtaggaattttggggatagtatggagttggtaattttttattaggtgtttttttatttgtttagagtttatggttgtgaggggtttttttttgtggttttgatttgtaattttttagtggttagtgatgttgagtatttttttgtgtttattgtttatttgtatatatttttgtagaaatgtttgtttaagttttttatttgtgtttgatttggatgattgttgttgttgagtgttaggagatttgtagattaatatttagatattaattttatatttgatttatgatttgttgttattttatggattgttttttttttatgttgttagtgttttttgatatgtaatttttttttttttttttgagatggagtttgattttgttgtttaggttggagtgtagtggtatgattttggtttattgtaatttttgtttttttggttttagtgatttttttgttttagttttttgagtagttgggattataggtatttgttattatatttagttaatttttgtatttttagtagagatggggttttattgtgttgattaagttggttttgaatttttgattttaagtaatttatttgttttggttttttaaagtgttggagttataggtgtgagttattgtatttaggttgatatgtaaatattttaaatttttatgatgttttattttatttatttgtttttttgttgtttgtgtttttggtgttatatttaagaaattattgttaaatgtaatgttaggaagttttttttttgtgtttttttttaagagttttgtggttttagtttttgagtttaggtttttgatgtaagttgagttgatttttgtatgtggtgtaagggttggtttagttttatgttttgggtttttgatttattttttttttttttttatgtttagttggttttgttgggtggtggggaggagtggggaagttttgggttgggtttgtatttgattatttttttttaggttagttagggagttttagtttttgtttaggatttggttggatgtgttttttattgggaaagtttgggttgtttttttaggttgatggtagggttagtttggggtgttttgaggtttgttttgtggatatgttttttgttttaggtggtgtggttgtttggtttgtgtgtgagattagttgtttgtgttttaggttatggaggttgagtgtttttagtttgtttttttgtttggttttttttttggggaagtttttgtagtttattttttgtttttgtttttgttatttgtgtttttgtttgttttttgtttggaggtggttatttttggggttattttttatgatttggatataagtttttattttgaagttattatttaaatttttgtgttttaaattttttttatttattatatgggtttttattgtgattaatttagtagttgatgaagttttttttggggtttttttagtaatggggagttggtttttttggaggtttggtttttttttaagtggaagtggggtgtgagggtgttagtttttttttgttgtttggtgttttaggttggtttgttatttttggaagtatttgttatttttatatagtattttatatttatttttttgttttttatttttttttttaaggggttatttttgtttttttttttatttaattttatttatgtggtttgtttagtaatttttgatttttaatatgataaaataaattttttttgttggttatttatttatttatttagtattgggtgttttttgtggatttggtgttggggttttgtggaggataaagttagatatagtttttgtttttatgggattgtataagtgtaagattatattagtaaatgtgaaatataggaagtgataggtgtgataaaggggattagtggtaggatagaatttgtggtttgtaggattaggttaggagggttgttttggggggatatttttgggttgagtgtagaaggatgaggggagtaaattaggtttaaatttagtaggtagaggtgattgttgtaggtaattggtaatgtgtttaaaggttttggggtgtggggggttgaggttggtagtatggtaggaagtaagattggggttgaaagagattgattgttatgttgtgaaatatatatttggtttttatttttattttttggtatataatttttaaaatttttggaatttttaaagtgatgtttttttggatgtttatgattgatagattagttggtagttttaggatggtttttagggaagattaggtagaattataaggtttagtattattttgtaatttttaggtaggggagaggggttgaaggttaagtagattattagtggttaatgattgaattaattatgtttttgtaatgaggtttttgtgaatatttagaaggatggggttttgggagtttttggatggatgagtatgtggaggtttttggagggtggagtgtttggggagtatatggaagttttgtgttttttttttatattttgttttatatatttttttttttgtattttttgtaatattttttataataaattagtaaattttatgagttttaggaatatgtgtaaaagaaaaaaaaaagaataaattatagttgttgtagtaagttaattttattagtattggtttttatttgttgattttatttttggtaatgttttttttttttgggtttttgggatttttttggttttattattttttttgtagtggttttgttggttgttgtttttaggttagtttatttttatttggtttgtttttattaggggttgaggtttttttgtttattttagttttttggtttgttttttgttttgggtatttttttattttgaatggttagagtttttgaagttgtttgttgtgtgtttttgtttggttttatgtattttgtatggtgttttttagggttttttattggtaagggtattggtatagattttggggttgttttggtttaagtttattttgatttggagtttgagggtttttgagggggttttgaaggttagggtaggtaaggttggtatgttttgggtagtgggggttgggtatgggaggggattgtgggtggggagattttttttaattagtggtttatgtttggagattgatttgggttttaggttatgttttgaaattgggatagagagtggtgtagattttagtttggagattttttttgtttgtggatgtttttatatttttatttgtggagttatttttttttttttttttttaaatggggaaattttgatttgaatattgaataaataatatatttttgaaattagtgaagaggtattggttttgaaattttgttatgaaagtttgaaaatgttttttggattgatttgttggaatagatgggtgtgatggggttgtggggttttaggtggtaggaggtgtttttgtgtttagggtattttgatgtttagagtttttttgtgtttagtgtgtttttgtatttagggtatttttatgtttagggtgtttttgtgtttagtgtgtttttgtatttagggtatttttatgtttagggtttttttgtgtttagggtgtttttgtatttagagtatttttatgtttagggtgtttttgtatttagggtgtttttgtttttagggtgttttgtgtttagggtgtttttgtgtttagtgtgtttttgtatttagggtgtttttatgtttagggtgtttttatgtttaggtattgtttttttttatttttttaatttttttttattaataggtgttagttgtgaaatgtttgttgtgtgtgttttttggttgagtttattttgtgtttttaagtttttgttagatataggtaggttgttttagtttttttggtaaatgttttgttgttgttgtttgatatggggttttattttgttatttaggttggagtgtagtggtgttattttgttttattgtaatttttgttttttaggtttaagtgatttttttgttttagttttttaaatagttgggatgataggtgtttgttattatgtttggttaatttttgtatttttagtagagatggggttttattatgttggttaggttggttttgattttttgattttaagtgatttatttagtttggttttttaaagtgttgggattataggtatgagttattgtgtttggtttgtttggtgaatgtttattgaggtttattatgtgtagttttttttttaggtgtttggtttgtaatgaggagtaataaagatatagttgttggttgtttgttatttaatagttggaattgagaggtagtttataaatgagtaaatttataggtggttttagatgaggattgtgaagaagttaagaataggttgttgggggtgtatatttgtgtgtgtggtgaggggattaatggaagttttttttgagtggtgatattgagttgaagttgtaatgattagaaggatttagttaggttaaaatttaagggaagagtaatttggtaaaggaaatagtaggtgtgaaggtttgaggttggagtttggggaaggtgggagtggttggagtgtgtttttagagatgggttatggtgatattaatgtgataggtagggttaggttgtgttgggttttggaggttttggtgagggtttgattttatttttattatggtgggattttagtgttttgtggttgttgagaatggttaggggtaggtagggaggtttgttagggaggaggttgttgtaggttttgtagttggagagggaggattaggatttttttagagaggaagttggagagggaggatttttttgattgttggatggatttatttgtttggttgtttttgttagtatttagtagaggttattggatgttgataggtggttggttttgtttagttttgtattgttttgtgttgttttggtggttgttggttttaggaggagtgtttttggtgtttgagtttagtggttttggttgtggtttggtatatttggttgtgggtgaggttaaggtggtttggattttgggaaggttgggtatttggtagttttaaggtaggagttggggtgttggaggaggaagtatgtttattttttgtttttttttgttttgtgggatgttgagtttttgggtagggatatggtgagttttggtgtgatgtatttaatatttgttggtgtttttatttttaagtaggaattttggtgtttggtgtttgaggattgttgtttattgttttattattttttaggtttttttttagtttttgatttggggtaaggtttagatatttagaatatttttggttggtttttggagttggggtgaggtagaattttttttttatatttatagtattagttaaggttttggggtttggatattatttttgggaggggtgagtaggataagtgaggtttttagatttggggtggttttggattggttaggtaggtgggtgggggttgtagtttatgtttttgttttaggtaatatagttgagttgtagtttttgttttatttttagttggggttttttgtgtttattttttgtttttttttttttttttggaatggggggtggatattttaagattagttttttagttattttttttgttttttgtttttttttttttgggatagatttttgtgattgttgggtgtttttgatgttttgttttttttgtgttttgtgttgtgggtgagagagggttttggggggattttttttttttggagtatttgttgttttgggtgtttttgggggtgggtttttattttatattgtggagttggtgtaggaaggaaggtgttgggagttagttttaatttatgtgttggttgtggtttttaaggtgtggatggtaggaggtggtgagatagggatttattgattatgggattgatatttttttatgttgatgtgggttttgagttataattttattagtttttgagttttggtgttgtttttggtgatggtgtggatttagttaggtttttgggtagttttttttggattttttttttgtttttttttgggtagtgtttttgtttatttggaaaggatgggtaggatttggagataatagggatttaaagaagttgggagtgggggtatttgtgtagtttattttgtagaatagataatttggttaaagtttaaagtttgttgttaggagttttgtttgttttttagagagtatatggtttgattattatggggattgggggagaggtataggtatgtttgtttggtagtagaagggaattttgggtttgggtttttttattttgtggtgttgtttttttttagagttgtattgttttttttattgtttttgtttggttttagtgtttatgtggtttgtggtttttagtttgggtttggttttttgtaatttattttgtttagttttatatagtttgtttttttagttgggaattggagtttatttggagttttaggtagtagatttgatgtagtgatgtagggttgttagttatgttagtaggttttgttgtttatagagggatgggtattgttgttgataataattaaagaattatggttttaggttgggtatagtggtttatatttgtaattttagaattttgggaggttgaggtaggagaattaattgaatttaggagttttagattaggttgggtaatatagtaaggttttgtttttataaaaaataaaaaataataataataataaaaattatagttttagaatgattgattttagtatgtttataaagttaagggtttttagtgttttgggtttatgttattgtgttagagggagagaggaagaggttggggtgatgggtattggggtttatgttttttttggaatgggtggttttggattgtgtttgtgtgatatgtttgttgagtgggggtggtgtttattgaggattggatgttgaggtgtgggtggggggaggttatgaagtattgggtattttttgtgtattagtgttttgagattgtagagaggggatttgtttagtttgggtagggaggtgggtggtagtgaggaaggggagaggaatttgggtgtagaaagttttttttttagtaggtggtgttgtaagtttttgagagtttagtttttgtggggtttgtatttttattgaatttgtgggtagaggttgtttgggtgtagtttttgttaattgtgattgtttattgtgggtgaggggaagtggagtgtagagaatgtattggagggtagatgattagtttttgtataggtatgggggtgtttttttttttgtataggtatggggggtttgagtttttggggtttttgttttaattgggtggggaaagggagggttggaagttgagttagggggaaagggggtggttttttgttattttttttattttattttttttatttttggttgataggttttaattttttttatatttttttaattttttgttgtaaaattttttaaatatagaaaagatgaaagagggttgagtgtggtggtttatgattgtaattttagtattttgggaggttgaggtaggaggattatttgagtttaggagtttaagattagtttgggtaatatagtgagattttatttttataaaggatataaaaaattagttaggtatggtggtgtaggtttggagttttagttatttggaaggttgaggtgagaggattgtttgaatttgggaggttgaggttgtagtgagttgggattgtgttaatgtattttagtttgggtgatagaataaaattttgttttaaaaataaaataaaataaaattataaaaaagaaattatgaaagattttaaagtaaatatttatgtatttattatttagattttatagtaattattttgttgtttgttttattataaatttttttggttattagtatttatgttggttttgatgtatttaaaataagttgtagaaattagtatataatattttgttaatattttagtttgtattttattaattagagtttggtatttgtttgtgattatttttgtttttttttgaagtaaaatgtatatattttgagatgtataggtgtgaaatgttttgttttttgaattttaataaaggtatttatgtgtattttagtttgattagaatatagaatattattattattttagtaagttttttatgtttttttaggtgtattatagtttttattttttttagggtaattataattgtgttttttttttattatgaaataattttgttagtttgagtgttttttagagttatttatgttgttgtaggtgttagtgatttgttttgttttattgttgagtaatgtttattgtgtgaatattttgtgggtttttagttatttttttgttgaaagatttttggttgtttttatttggaggtttttatgagtaaatttgttatgttggttttttttgtataagtttttttgtgtatatgggtgtttatttattttgtagaaatatttagagtaggtatagggtaggtatatatttagttttataagaaattgttagatttttttttaaagtggtttttttattttatatttttattagtaatggatatgagttttagttgttttatattttggttaatatttggtgttgttattttgtgaaattttagttattttggtgggtgtgtagtggtattattttattatggttttaatttgttttggtttgatgattaatgtggttgagtatatttttatgattggttttttatatattttttttttgtgaaatgtttttttaaatttgttgtttattttaaaattgggttgtttgatttttttttttggatattgattttttgttagatatgtgttttataaatattttattttagtttgtggtttgtttgtttattttttttttttttttaagaataaggttttgttgtattgtttaagtaggtttgaaatttttgggtttaagttgtttttttgtttttgtttttttaagagttggttttataggtatgagttattatgtttggtttgtttatttttttagtggtattttttaataagtaaaagtgtgttattttaatttttatgaagtttaatttaataaatttttttttttgtggttttttttttgtgttttttgtaagaaatttttgtttattttgttaaattgtaaagatatttatgtttttttttagaaggtttagagttatatagtttttatgaattaatttttgtatatggtgtgaggtagagggttagggtttattttgttgttgttttatgtgtttatttagttgttttaaattttatttttttttaaagtttttattttgtatttttttggtgatttatgaggttgtataattttttaagatttttgttggttatttatgtatttttttttgtaaaattatttgtttatgttttatttttttttaaaattatgttgttttaagattgagtgatttttgaagtttttattttataatgtttgaaagaatgaatattttgttttttagttataggtttttgttttttgttttgtagttgtatagtggggtaagatttgggttttgttttgttgttgttttgttgtttttttatttgattgtttttttatgggttttatttaaaaaaaaaattggttgggtatagtggtttatgtttgtaattttagtattttgggaggttgaggtgggtagattatgaggttaggagattaagattattttggttaatatggtgaaattttatttttattaaaaatataaaaaattagttgggtgtggtggtgggtgtttgtagttttagataattgggaggttgaggtaggaaaatggtgtgaatttgggaggtggagtttgtagtgagttgagattgtattattgtattttagtttaggtgatagagtaagattttgttttaaaaaaaaaaaaaaaaaaaaatgttgttttatatgttttttatatattttggatataagttttttattagatatatgtattataagtttttttttttatattgtttttttttttttggtttttttaatgatgttatttaatgagtaagagtattttgtttttataaagtttaatttattaattttttttagttttgatttatgatttttgtgatttatggaggaaatttttgtttatattaaggttaaaagaagtttttttattttttagaaattttatagttgtatattttatgattttttttattttttaattttttaaatttttatattttttaatttattatagttgttaggatgttgtatgatttattttaaattagtttttgtatttggtttgaggttagggttaatttttgtttttttatatttatatttagttttagtattgtttgttgaaaagatatattttattttattgaattatttgatatttttgttaaaaattattgattgtatatgtggttttatattagtatatgtatgtatatatatgtaggttttgtgttgattgtatgtgtggttttatattagtatatgtatgtatatatatattggttttatgttgattgtatatgtggttttgtattagtatatatatattagttttatattgattgtatatgtggttttgtattagtatatgtatatatatatatgtaggttttatgttgattgtatatgtggttttatattagtatatgtatatttatatatgtaggttttgtgttgattgtatatgtggttttgtattagtatatgtatatatatatatataggttttgtgttgattgtatatgtggttttgtattagtatatgtatatatatatatgtaggttttatgttgattgtatatgtggttttgtattagtatatgtatatatatatatataggttttgtgttgattgtatatgtggttttgtattagtatatgtatatatatatatgtaggttttatgttgattgtatatgtggttttgtattagtatatgtatatatatatatgtaggttttatgttgattgtatatgtagttttatattagtatatgtatatatatatatgtaggttttatgttgattgtatatgtagttttatattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatatatatgtggttttgtattagtatatgtatatatatatatgtaggttttgtgttgattgtatatgtggttttgtattagtatatgtatatatatatatgtaggttttatgttgattgtatatgtggttttatattagtatatgtattgtatatatgtaggttttatgttgattgtatatgtggttttatattagtatatgtattgtatatatgtaggttttgtgttgagatattattgtgtttttttgatattttgtttatttttttgttgatgttatattttgattaatgtggttttatagtaagttttaatataaagttttttaaatatttaaaatattattttgaatattttaggttttttgagtttttttataaatttaagaagtagtttgttgatgtttataaaaatgtagtgtgaattttggttgagattgtgttgaatttgtagattaattaaggaagaattggtattttaataatattgagttttttgtatagatggtatatttttgttttaaaggtttttttgtattttttttatttttttattgaaaaaaaatttttatagaattatattgttttgtagtttttaagaaaaagattttgtatgttatttgttaaatttatttttaagaattttatttttggtattattttaagttgaaatagattttaaattttatttttaattatttgttgttagtatgtaaaaatataatagatttttgtatgtaaattttatattttatgattttttttaaagttatttattattttggtaatggttttgtaggttttttaggatttaaatatatagttttatttttttttgattttgatgttttgttttttttttttgttttattgtattggttagagttgttagtttagtattgaatagtagtgattagtggatatttttgtttgtgttaaatttataatgttaattttagatttgttatatatgatttttgttagattgaggaaatttttttttatttttaatttgttgaaattttttaatatgaatgggtatgattttagtaaatgttttttttgtatttatggaaatgattattgttttgttttttatttgtttaataggataaattataatgattgatttttgttttttgttttttttttttttttttttaaagaaatagagttttatttttgtttaggttgtagtatagtggtgttattgtagtttattgtagtttgaatttttggatttaagtaatttttttattttagttttttaagtagtagggattataggtatatgttattatgttaagttaatttttaatttttaaaattttttgtatagatggggttttattgtgttgtttaggttggtttgtaatttttgagtttaagtaatatttttatttttgttttttaaagtgttgagattataggtgtgagttattgtgtaggtttgattttttaatattgaattaattttgtatttttggaagaagtttaatttgtttatgagatattattttttttatatattgttaaatttgatttgtttagtttttaaggatttttgtgtgttgatttatgagggatattggtgtggtattttttttgtttgttagtttgttttggtaatgtttttgttagttttattttggttttataaaattagtttggaagtgtttttttttttttgttttttgtgtttttataaggttgatgttgttttttttttaaatgtttgatagaatttattaagaaaattgtttggatttagaattttttattaggaaaggtgattgtttgtttttaattataaatttaatttaatgtatagaaagagttatttaggtttttttatttttttttgttttatttttggtaagttgtattttgaaggaatttgttttttttaggtaagttgttgaatttatttatttaaagttgtttgtaatataagtatatttagggtttgtttttagattttggtaataaagtaaatattgtaataaagtatgttatataaattttttggttttttagtatatataaaagttatgtttaggttaggtatggtggtttatgtttgtaattttagttttttgggaggttaaggtgggtggattatttgaggttaggagtttgagaatagtttggttaatatggtgaaattttatttttattagaaatataaaaattagttgggtgtggtggtatatgtttgtagttttagttgtttgggaggttgaggtgggagaattgtttgaatttgggaggtggaggttgtggtgagttgagattatattattgtattttagattgggtgatagggtgagattttattttaaaaaaaaaagaaaaaagttatgtttatattatattatagtttattaaagtgtataagattattatgtttttttgttaaaaaatgttaataattatttgagtttttagtaagttataattttttttttggtagaaggtttgttttaatgttgatggttgttgattaggtggtggttgttgaaagttgaaggtagttgtggtagtagtttttttgttttttttttttttttttttttttttgagatagagttttgttttattgtttaggttggagtgtagtggtatgattttagtttattgtaatttttgttttttgggtttaagtaatttttttgttttagttttttgagtagttgggattataggtgtttgttattatgtttggttaatttttgtatttttagtagagatagggttttattttgttggttaggttggttttaaatttttgattttaggtgatttatttgttttggttttttaaagtgttgggattataggtgtgagttattgtatttggttggtagttttttaattgaagtttttgatatgggttgatttttttttttatgaaagatttttttgtggtatgtattatgtttgatagtattttatttataatagagttttttttaaaattagagttaatttttttaattttggttatggattgattaaataagttgatgtaatattttaaattttttgttgttattttaataatgtttatagtatttttgtttggagtagattttatttttaggaattattttgtttgtttatttataagaagtaattttttatttgtttaagtttgattatgggattgtagtaatttagttttatttttaggttttatttttaattttagttttttgttatttttattatatttgtagtgattttttttgttgaagttttaaattgtttatttatgagggttggaattaattttttttaaatttttgttaatgttgatattttaatttttttttgtgaattataagtgtttttaatggtatttagaatggggaattttttttagaaggtttttaatttattttgtttagatttattagaggaattattaattatggtagatattgttttataaaatatattttttaaataataagatttgaaaattaaatttattttttttttatgggttgtagaatgggtgttatattagtaggtatgaaaataatatttatttttatatatatttttgttagagtttttgggttataaggtgtattgttaatgagtaataatattttgaaaggattttttttttttgagtagtaggttttaatgatttttttttttttttgatggagttttgttgtgttatttagaatggaatgtggtggtatgattttggtttattgtaatttttgttttttgggtttaagtgatttttgtgttttagttttttgagtagttgggattataggtatatattattatgtttggttagtttttgtattttttgtagaaatagggttttattatgttggttaggttggttttgaatttttgattttaggtgatttatttgttttagttttttaaagtattgggattataggtatgagttattgtattgggttttatttgttttttttttgttgttgttttttaattgagatagagttttgttttgttgtttagattggagtgtagtagtgttattttagtttattgtagtttttgttttttaggtttaagtgatttttttgttttagttttttgagtagttgggattgtaggtgtgtattattatgtttggttaatttttgtatttttaatagagatgaggttttattattatgttggttaggttggttttgaatttttgaatttaggtgatttgtttgttttggttttttaaaatgttgggattatagttgtgagttattgtgtttggtttttttttgtttttttgtttttttttaaattgagatagagtttttttttgttgtttaggttggagtatagtggtatgattttggtttattgtaatttttgttttttgggtttaagtggtttttttgttttagttttttaagtagttggaattataggtgtgtgatattatgtttgaataatttttgtatttttagtagagatgtggttttattatgttggttaggttggttttgaatttttgattttaagtgatttttttgttttagtttttaaaagtgttgggattataggtgtgagttgttgtattaggttttaatgggtttttaatatttagtaaattatgttgtaaatagatgtgttgttaagtagggtttgttattttatttttgaagtatagatagaatagatttggtagaatttttaagggttttaggatttttggaatggttaatgagtattggttttaatttatggttaatagttgtgttagttttttatgagagttagtttgttttttgaagttttaaagataggtattgattttttttttttagttatgaaaattttagatgatatttttttttagtagaaggtgggatatttatgttgaaattttgttgtttagtgtagttatttttattagtgttttgagttagattttttgggtaatttgttgttgtttttttattagtatttgttgttttattttgtatttttatattatagagatggtttttttttttaaattttatgatttgatttttgttagttttaaattttttttttttagtttttttattttttttagtttttatattattgaagagagttagggttttgttttggattaggtttttgtttaagggaatgttgtggttgatttgattttttatttagattatttaaattttttttatattagtattaaggttgttttgttttttttttttttatgtgtgtattggaattgtatttttaattttttttaataatttttttttggtatttataatttggttagttatttggtataagagattttatttttgtttgttttggtttttgatatgttttttttatttagtttaattatttttagtttttgatttaaagtgagagatgggtgatttttttttttatttgaatatttagaggttattgtagggttattaattggtttaattttaatattgttgagttttagggaatagggatgtttgagtagagggagagagagtggggaatagttagttagtggagtagttagaatatataatgtttattgaataagtttattgttttatttggatgtggtttgttatgttttaaaaataattgtaataatggtattgaagattattgattattgggtgtggtggtttatgtttgtaattttagtattttgggaggttgaggtaggtggattatttgaggttaggagtttgagattagtttggttaatatggtgaaattttgtttttattaaaaatattaaaattagttaggtgtggtggtgggtgtttgtagttttagttattggggaagttggggtagaagagttgtttgaatttgggaggtggaggttgtagtgagttgagattatattattgtattttattgtattttagtttgggtaatagagtgagattttattttaaaaaaaaaaaaaaagggttgggtgtagtggtttatgtttgtaattttagtattttgggaggttgaggtgggtagattatgaggttaggggattgagattattttggttaatatgatgaaattttgtttttattaaagatatgaaaaaaatagttgggtgtggtggtgggtgtttgtagttttagttatttgggaggttgaggtaggagaatggtgtgaatttgggaggtggagtttgtagtgagttgagattgtgttgttgtattttagatagagtaagattttgttttaaaaaaaaaaaaataaagaaagaaaaaagaaaaaagagattatagattattatagtagatataataataatgaaaaagtttgaattattttaagaattattaaatttttatatagagatatagtgttaatatgttgttggaaaaatggtgttagtagatttatttgatgtagggttgttatgaatttttaatttgtaaaaagtgtagtatttgtgaagtataatgaaatgaggtgtgtttgtgttttttgttattgtaatgttggtaggatttgtaaggaaaatattttattttttttattgtgattttatgtttgttattttttttttattagtagtttggttaggaggttattaatttagatttttttaaagaattagtattggattttttttttttggtgtttatttttttgagtttttttgttatttttattatttttttttttgtatttgttttagtgtattagttagggtttagttaggaaataaaaattatattggtaatttgaatagtaatttgtaatataaagtgtttttaattgtaagaggtagttaattattaaagggattataaaggggtgatattgtgatataagaaagatgtatttgggttgggtttggtgtagtggtttatgtttgtaattttagtattttgggaggttgaggtaggtggattttttgagtttaggagtttgagattagtttgggtaatatggtgaaattttatgtttattaaaaatataaaaaattattttggtgtggtggtgtgtgtttgtggttttagttatttgggaggttgaggtgagaggatagtttgagtttgggaaggtagatgttgtggtgagttgagattgtattattgtattttagtttggatgatagagggagattttgttttaaaaattaatgtatttgtttgtttgtttgtttatttatttatttatttatttatttatttatttatttagtttttgttttttaattttgtttggtatgtagtttttaaaatttttgaaatttttaaagtgatgggtgtttttttgtttgttaaggaggtgattggtggttggaggtttttggatagtttggggataagggttggttgttaggggatttagttttgtgattagaaggttagaatttgtagttttttttatttattttttgtgaggtaagaggggatgaaggttgagttgattattaatggttaaagattttatgttatgtttatgtagtgaagtttttttgaaaatttaaaaggatgaggtttgtagagttttaggttgttgaatatttgtaggtgttgggagggtagtgtatttttttgtggaagttttatgttgttttttttatattttttttatgtattttttttagttggttgtttatttgtattttttgaaatattatttgtaataagttagtaattttaagtaaattgattttttgggttttgtgagttatttaagtaaattattgaatttgagaagggagttgtgaagattttaaatttgtagttaagttagatagaagttatgggtaatttggtgttttattatttgtgattgatttttgaagttgagggtagttttgtgagatggaatttttaatttatgggatttgtattaattttggttggtgttagaattgaattgaattgtaggatatttagttggggattgttgagtattggagaattgtttgggggttggtgggaggaaattatatatttggtgttagagttgaagtattgagtgttgtgaatgagagtggagagatagagtttgttttgttttatgtaagaggattttaaggagtatagaaagagtaaatatgagaagtagttattttagaagaaaatataggaggaaagttttgtgatattggagttggtaatgtttttttggatgtgatattgaaaatataataaaagaaataaatgataaattggattttattaaaatttaaaatttttgtgtattaaggaatattattaatggtgtgaaaaggaaatttatagaatggaagaaagtatttgaaaattgtatatttgataaaggattagtatttagaatatataaagaatttttataattaagttataaaataaaaaaaaataatttagtgaatagatatttttttatagaagatatattaatggttaagaagtataggaagagatgtgtagtgttattaattattagggaaatgaaaattaaagttataataaaatatgattttatattttttaaggtggttgttagttaaaatatggataatagtaagtgttggtaaggatatggagaaattggagttttgtgtattgttggtgggaatgtaaaatggtgtagttgttgtggaaaagatataataattgtttaaaaaattaaatttagaatgattataatatttagtgattttatttttagatgtatattttaaagaattgatagtagggatttgaataggtgtgttatatttttgtttgtagtagtattttttttataattaaaagatgtaggtaatttaggtgtttattagtggatgaatgaatagataaaatgtggtttatttgtatagtggaatattattttgttttaaaaaggaaggagaggttaggtgtggtggtttatgtttgtaattttagtgttttggaaggttgaggtgggtagattatttgaggttaggagtttgagattagtttggttagtatggtgaaattttgtttttgttaaaaatataaaaattagttaggtatgggggtatgtgtttgtaattttagttattagggaggttgaggtaggagaattgtttgaattagggaggtggaggttgtagtgagttgagattatgttattgtattttagtttgggtgatagagtaagattgttttaaaaaaaaaaaaaaaaaaaaaaaaaaaggagattttgatatatgttatagtatagatgagttttgaagatatgttaagtgatagaagttagatatgaaaagataaatattgtatgattttatttttatgaggtttttagagtagttaaatttagagagatagaaagtgggatggaggttgttagaggttgggggaagggagaatgaatgggaagttggtgtttaatggggatagaattgtagtttgggaagatgagatggatggtggtgatggttatataatagtgtgaatgtgttttatgttattaaattgtatatttgaaaatggttaaaatggtaaattttttgtgatggatattttaaggtatgtatgtaaatatatagaagtagttattattattggggttgatggaaaagaaattaagaatttggagtgttttttatattttgttatgttttatgtttaggttttgttggagagtgtgtgattgttatagaaatttgtagtttattggtaataaaaaggtttttgttagaaggtgtagaaagagtggatttgtaggattagtttattgggtagttgagaaatttattagagggtatgggtgggtaggagttgggtgtttgagaagtttgttgaggttttattgggttagagttggggtgttggagaaatttagtatagagtaggttttattgggtatatgttattggtagttgtgtttttagaggaaaaagagattttggaattaggaagagaagttgttattttagtaaggtttggtagttttttatagtgttgttttttgtggatagagtttgatatgattgtatttggttaaggagaaagatttataaggttttggtttagtattatggagtggggtttggtaggatgtatgtagagttaagaggtaatatatgggtaattggtatatttttttagattttttgttttttttgttgttttgttttgttttgttttgttttgttttgttttgagagagtattttgttttgttgtttaggttggagtgtagtggtatgatttaggtttattgtaatttttattttttgggtttaagttatttttttgttttagttttttaagtagttggagatgtttattatgtttagttaatttttgtatttttagtagagatagggttttattatgttggttaggttggttttgaatttttgattttaggtgatttatttgttttggttttttaaagtgttgggattataggtgtgagttatattgtatttggtttatttttttagatttttaaagtagatttttaggtttttttttttttttttttttttttttttttattttttttttaatataagtatttatagtttttttttaagtattagttttagtttatgtattttagtatgttgtgtttttattattattttatttgaaatattgtaaaattttttttgtgattttttttttgatttatgggttatttagaagtatgttgtttaatttgtaaatagttaaggtttttttgagtattttagagttattgatttttaatttaattttattttggttagataagtatattttgtatgtttttaaaatttgagatttatggtttagaatgtgtattttggtgaatgtattgtttttatttgagaaaaaaatatgtatatatattttagattttttgagtatagagttttataattgttgattaggttaattgttagttattagtgttttttagattatttgatgtttgttttttagatgttgagagaatggtgtttgttatggtttatttgtttgtgttttttaaaatttatatgttggagtttaatttttggtgtagtggtgttgggaattggggtattagggaagtattggtttatgagggtagagttattgtgaatgggattagttttttttgttatgtggggatatagtaggaaaaggatatttttgaagtagggagttagtttttattagatattgagtattttgattttggattttttagtttttagaattgtgagtattataatttgtttataaattatttagtttaaggtattttgttttaatattttgaatgaattgaggtggtgttaaaatttttaattatgtatttaggtgtagtggtttatatttgtaattttagtattttaggaggttaaggtgggtggattatttgaggttaggagtttgagattagtttggataatatggtgaaattttgtttttattaaaaatataaaaattagttgggtgtggtggtaggtttttgtaattttagttatttgggaggttgaggtaggagaattgtttgaatttaggaggtggaggttgtagtgagttgagattgtattattgtattttagtttgggtaataagagtgaaattttgttttaaaaaaaaaaaaaaagagtttttatttatgattgtggaattgtttatttttttttttaatttttttaggttttatattatgtattttgaagtttttttggttaggtgtatatatatttatgattataatggtgttttgatgaattgattatttaattatgatgaatgtatttttttattttgtaataattttattttggatttaattttattgatatttatgtagtttttttagtttttttaaatatgttgtttgggatgtataagaaggttggagaggtttatggagaaatttatgatggtttgatttatagttttttaattttattatggtgtgaatgtggtatgtatatagtagaaattgtattttaagtatgtgtgaaattattgtgttttttatttttagtatagtatttaataatttatatgagatagttaatattttattataaaataggttttgtgtttgttgattttgtttaattgtaggttgaagtaagtgttttaattatgttaaggtaggttaggttaagttagaatgtttggtaagttagatgtattaagtgtatttttgagatgatatttattttttatttatgatgggtttgttaagatataattttattattatttaagtagtattagtatgtttttttttaaatagaaaattttaatttgtgtttatattgaaatagtattttttgtagatagtatatagttgagttttgttattttatttattttgatagtttttgttttttaattggaatatttaggttatttttgtttaatatagttatagatatgattgggtttagagttattattttgttttttgatatttattttttttattttgtttttttggttttttttatgttaattaagtattttttagaattttattttaatttatgttttttttttttttttttttttaagatagagttttattttgttgtttaggttggagtgtaatagtatgattttggtttattgtaatttttgttttttgggtttaagtgatttttttgttttagtttttttagtatattgggattatagatgtttgttattatggttggttaatttttgtatttttagtaaagatggggttttattatgttggttaggttggttttgaatttttgattttaggtgatttgtttattttggttttttaaagtgttgggattataagtgtgagttattgagtttggtttgttttgattttttaattgtatttttttgtattgttattttagtagttattttatagattttattgtatatttttagttttttatagtttatttagaattaatattgtttttttttatggaaaaaaagtgtaagaattaggtaattttatgggtttatttattattttttattttgtatgtgatggttgttagatatttattatatttatatatattgtaaattagataatataataaggaaatttttgttttaaatagttttatgtattttaaagaaattaaaagtaaaatagaattttttttatttgtttatgtatttgttatattttgtgttttttatttttttttgaagagttgagtttttatttggttttattttttatgattttggagaatttgttttatggtttttgtagtgtaggtttgtagatagttaatttttttttatttttatttatttgtaaatttttattttgttgttattttttttttttttatttttatttttatttttgagatagagttttattttgtttttttataggttatagtgtaatggtgtgattttaaaatttttgtttaattttaatttattaattttttttttttgggtttaaatgatttttttgttttagttttttaagtagttgggattataggtatgtgttattatatttagttaatttttgtatttttagtagagatgggattttattatgatggttaggttggttttgaatttttgattttaagtgatttgtttgttttggttttttaaaatgttgggattataggtgtgagttattgtgtttagtttgttgttatttttgaattataattttattggttatagaattttgagttgttagtttttttttttaggattttaaaatatagggttttagtgtttttggtttttgttgtttttgttaaggaattagtatttatttagttatttttttgtagattatatgttgtttttttttggatgtttttaagattttttatttaagtttgattgtttagtatttatttttgggtaaaaaagtttttagaaattagaaatttatttagttttatttttttttgttaggtgtagattttattttagtttttatttatttgagatattttatattgattttaggttgttgttattttgtttttttaaatattttgtttagagttataatgttttttgtagaattgattagatagtagttattttttgtgattaggagttttgattttttagatttgttgatgggtttataaagtttttgtttgtggtttttagttggtagtggtttttttgttttgaagttgttatgagtgtgtaaaatttataggtttaattttttttattagtatagtttagaaaagtggaatttttggtttgggtggttatggtgttttagattattggttagattagggtggtgattgttagttggttgaatgtggggtttttagtttagtatttttggattttattttaggagttatggttgttttagggttaggggtttggttttagtttttgtttttttttttttttttttaagttgtttagtattaggttttaattagtattttttgtagatagggtgggttggttttttattagaggggtagggttgggtgggaagtttgttgagtttttttttttgtgtagtttatagttttggggttagttttagaggggtgtagaaaggagtttttaaaggtagaaatttatttttttttttgtttttgtgtttttagggataaaggagaggtggttttagttggggggttattagtggtatgtaggaggtttatatgattattgtttgttggggtttttttttttttgtgagagagatgagagagaggagagagagtgtgagttagggtagtgtttttttttagtaatgtagatttttgtatgtgttttttaggagaaattttgttatttgttagagttttagatttggaagaagttttgtttttttttttttttttagtgtagtgtgtgtgtgtgtgtgtgtgtgtgtgtttttatatgtattatatttttttatagaggaaataatttttgtttaagtgtaaaggttgggattggagtaggtagtatgtgggttaaaggagtagagaggaggaaatgggggtgggggtgagggtgggaataggaggtgggtagatgttatgaggtatgttttttataattagaagggttggtggagatgattagaatgttttagatagattttttattaaatttttaaaatttaattttgttttatgaagtttgaggattttgtagagtgaaagataaggaagggtttttttgtaggggggtgtgtgtgtttgtgtgtgtttgtgtgttgtgtgtttttatgtgtgtgtatgtgtggatttgtgtggtgtgtgtttgtatatgtgtgtatgtgtggatttgtgtggtgtgtgttgagtgtgtatatgtgtgtgtttgtgtgttgtgtatgtatttgtatatgtgtatatagattttattttttttttttttggtttattaagtgttagaaagaatttttgtgagtttttttattttttttaaggttgtatatggagggatttgtgtaggtatatgtgtgtgtgtatataatatatatatatatatatatatatatatatatatatatatatgagttaggggtgagtatttttgtggattgtatttaggtttggtaggaaattgggttttgggaaattgtaggttttatttttggtagaaaattatgtttttgttgttgtttgttgaagggaatattaagtggggttggggatagtttatgttgagaagagtaaattttgtttatggtattggggatattgagtggtttttgttttgggttttggagggtttgggagatatgtttgtagttttgggtattttttaaggttatgggtggttatatttaaggttaggtttttttttgtgtgagttgtggttagtaggaaggttgattttagaggtggttttagggtttttggaggttttgtttttgagatatgggttaaggttagagagttgagaaggttgttgttgaggattttggttggtgtttagtttagtggttttttaggtgggttttgtgtaggggttgatgaagttagttgggaaatttgtgaaataaagtataggttttttaggtttgtttagagttttggtattagatgaggtgtagagaagggaattgagttgttaagtgtgaataggagagaggagttttaggattatataggggttttgatatggtaggtgtttggttagtagtggtgttgtttttattgttggatgtgggaaaatgtattgatatttgttgattagagttggggtgagtatttgggtgattttgtagatgagataaaataagggttgttgtgggggaggggtttttgttgggttattttgttgaggttttgtgttattgttttgtggttgttataataaaggattataaatgaggtgatttaaaatatttgaaattggttatgtgtggtggtttatgtttgtaattttagtattttgggaggttgaggtggttggattatgaggttaggagattgagattattttggttaatatggtgaaattttgtttttattaaaaatataaaaaaaaaaaaaaaattagttgggtgtggtggtgggtgtttgtagttttagttgtttaggaggttgaggtaggagaatggtatgaattttggaggtggaggttgtagtgagttgagattgtgttattgtattttagtttgggtgatagagtaagattttgttttaaaaataaaaataaaaataaaaataaaaatatttgaaatgttttttttaaagtttttggagttagaaattttagattgaggtgtttgaaggtttattttttttgggggttttgagggagattgttttatgtttttttttgagttttgtggtggttagtaatttttggtattttttggtttgtagtttggtttattttttatttggtttttattttgtgtttttttttgtgtttttgtttaaattgttttttttgttgtttttttaatttatttttagggataggtttttattttgttttttaggttggagtgtagtggtgtgattatggtttattgtagttttagttttttaggtttaagtaatttttttattttagttttttaagtagttgggatataggtgtatgttattatgtttggttaattttttaatttttttgtagagatgagggtttaggttggttttaaatttttgtgtttaggtaatgagattttgttttttaaaatattgggattagagatatgagttgttgtgtttagtttatttttgttttataaagatatttgttattggatttagggtttattttgatttaatatgtttttaaataatttaattatatttttaaagattttatgtttatataaagttatatttataggtattggggggttaggatttgtatatgttttttgggggaatataatttaatttataatgggttttatttatagaatgaatggtttttttagggtgtgtgtaggtgggtgaggggtttaggagagggatttgtgtggtaagagggtttgtgtttatgttagagattttagaaggagattggatggggtggttgtatggagtaaggggttatagttattgtttttaagtagttggtgggttgtttggtagaaagggagtatttattttgagtttttttaagatatgaagttagtattaggtatttggaaggtgttagtgagtagagtttgattttttatagaaagaggtgttttttttataatgtttatttgaggatggtggaataggttattttataaggtagtgagttttttatgtttggaagtatttaagtaggggttatgtgggagttgtttaggagtgtatagaagggattttagaggtttttgttaatattatttttgtttgttttattttatgataatttgaattttagaatgtaatgttattggggatatgtttattagaggggtttttagtattaggttttatatattatgtattatttttagggtagggaatgagagtaggttttattttttttggttgtttgtgaggattaggaggtttgttgttgaggtagttttttgtggaaatagtgttttagttttgtaatttatttattggagttttaatattttaatgaaatattgtgttagatgggttttgggtatgtgtgtgtagattgttataagtttatgagaatgtatatatgtatattgtatgtgtgtgtatatatgtatgtatatatgtataagaatatgaagatttgaggtaggtatagtttgtgagatagatttttttaggttgaaagattttttataagggtttttagaataaggttttagttttggtagttttttttatttttggtgggaggatttttatagagaagaagggttaagaagtatagtttttgatgtttatggtgtattaagttttgttttaagtttgtgttttattttttatttatttagtaaatttgttgtttttgttttgtgttagatgttgtttttagtattttataaatattgatgtatgtttgttttatgataattttgtgaagtaggtagtgttattttgttttatagatgaggaaataggtgtagagggataaagggatttgtttaaggtttgtttttattttatatgtatatgaatgtttatttatgtggtaggtgttagtttttttttgatgtgagttaggttttgagttggttggggtttgggttttattttggttgtgttttgttgtgggtattaaggaagtttttagtagttttatttttttggtatgatttagttttagggattggatttttttaaatgtttttgtttagtttggagttttttttttagttgggggagggttgaatgattttttatttttggaggttgttggagttttttttgtttgtatgtggttgttgttgggtggataggtttgtttgtgggttgaggtttttagtagttggggtggattatttttttttttaagaagttttgggagaagtagttgagggggttagtgtttttttgaggttaattttttgttttttttagtgtaggtgtgaagttatttttgtttgtgtgtttgttatagatagtggagggtggtgtaattgtgatgtttgtttgttgtattttgtgtttttgaggatgttgatttttggttggtgttgggtgtttgttttttagttattttgttttgatttggtgtggtaggtttgagtattgtttttttataaggaaataggtttagaggttttgagttatttgtttgggtttttttagttaataattggttgagttaggatttttatttagttttgtgattttagaagtttaagttttttttattatgttagggttaggaaaggattagaatgtttttttatgtgttgattatttggatgatttgtgtagtttagtttgttgtagttgtttaataaaaatgtggaatgaatgggtttatatgttttattgtgtgatttagagttaatgattttggttgatttttttgtttttattttgtggtttagtatttttttttggggtgtgtgattttggaagtagtgattttttttattttattttgaatggtgtttgtgttgtagtaggggagtagttggggattgttagtgtttgttgttggtgggttgtgtgttagattttgttttggatgtgtgggtgattgttagttatatgtgtgtgaagggttgtgtgtgtaggatttgtgtaaatgtgtttttttttgttgttagtttatgggaggttgttaagattttgtttttgtatattagtttatattttttttgtggtttattgttgtggttgtttttttgtgttatgtggttgtaggtatagtttttaagtggatggggattgtgggttgaatgtgtattagatgtttttgttttttggtgggtggagatttttaatttatgtattgtggttgttgtatttgaaaggttttttatggtgaaggatttggatttgagtaattttttgtagaggttttagaagtgttttttggttgggtgtggtggtttatatttgtaattttagtattttgggaggttgaggtgggtggattataaggttaggagattgagattattttggttaatatggtgaaattttgtttttattaaaaatataaaaaattagttgggtgtggtggtgggtgtttgtagttttagttatttgggaggttgaggtaggagaatggtgtgaatttaggaggtggagtttgtagtgagttgagattgtgttattgtattttagtttgggtgatagagtgagattttgttttaaaaaaaaaaaaaaaatgaagtgtttttagtttttttttttgtggtgaggttttgagtttttatttttagaagaaaatttggttggggagggtatttttagatttggatataaatgttaggagattagggttgtttttttaggtgattaattatagagatttagggaaagttatgtttggaagaggtgatattgtgttttagttttatttatttttttattttatagatattgtttggtgtttagtttgtattgtgaggttttttaagtagttttgggtattgtgtatttggtatggtttttagttttatttttttgttttgggagatttggtggggattttgggttgagtttttgtggttgtggaattttggtggtttattgtggtggttgagaatagggatgtggggttggatgggttgagtgtaatttttagtggttttgtgaattgtttgggagttttgggtagtttttttttattttgtgtttttgttttttgatggaaaaatgggggttaggggggagtgattttgaaggtatttgtgggaattaagtgaggtgataaatgtagtgtttttggtagagaattggatatagagtttatttttatgaagggggttgttttttttttttttatgtttttttttgtttttatttttttttttgtattttttttttttgtttttttttttttttttttttttttttatatgtaggtatattttatttggtgttttaattgtttttttttattgtttttttgtaagtggttttttaagtgggaatttaggtttggaaagggtgggtattttgtttggtgggttttggtaggttaggtgttgagtagttttaggagatataattttaggaaaaggtttatgtaggttggttgttatgatggattgttggtgggagaggggaaggtgttgtggtaggggaagttttggaaatatttattagtggttttatttatgatttaggatatttgttaggttattagaatatagttgaggaagttgttggttagatgtttagaagtattaatttggtggttgggttgtggggggatttttttggataggtagataaggtgttggaggaaggggttgatatttatttagtgtttgttatgtattgagggtataaagggtaggatggagagttggtttatgttatttgtggaattttttaggtgtgggggtagatggggaagtaagggggtttgaagatatatgtgtttattaaatgtttttaaattttaagaagaagaataaggatatatttataggggtagggttgaaagtttgatgtatggtgttttggggtttgtttttgttgtaatagttatagtggtttttttttattttttttttttttttattttgttgtgaaaatgtttaaaatatatggttaagttgaaagtattttatagggaatatatttagttattatttagattttattattaatattaagttatatttgttttattattttattgtttatttattttttttttgtttggttatgaatttattttatttttattttttggtgtattttaaagtaattttaggttattttgattatttttggaattattgttagaaatttttttttttttttttttttttttttttttttttttttttgagatgggattttgttaggttatttaggttgaagtgtggtggtgtagttatagtatattgtagtttttaatttttgagtttaagtaatttttttgttttagttttttgagtagttgggattgtaggtatttattattatatttagttttatttttaaaattttttattaattttttattttttgtatttatttaggattattttttataaagttagggtgttgtaggaggggttagaattttaagttttaattttggttttgttattaatattgtgtgatttttagtaaattattttgtttgtttaggttttgtttttatttttatgaaatgagggtgttaaattgtatgttataaataatgagggttattagttattaagtttttattttaggttaggtattttttatatgttattatgagtttttttaatttaggtattgtttttaatggatagtttagttaatggaagtttagagaggtggtgtaatttgttaaaagttttattatttagtgaatgtttttatggggtttgtatttaggagtttgatatagagtttaggttttagtatttggtgatgttttgggggtgtgagtagtttagtttattttgggtatgtgtttatttgttgttttttttgttttatgtttgtgtttgttttttttgaagtttagattgttattttttagttttaaatattaaaattggttaggtatggtggtttatgtttgtaattttagtattttgggagattaaggtgggtggattatttgaagttaggagtttaagattagtttggttaatatggtaaaattttatttttataaaaaatataaaaattagttagatatggtggtgtgtatttgtagttttagttatttaaggagaatttagttatttagttattgaggtatgagaattatttaaatttgggaggtggaggttgtagtgagttgagattgtattatttttttttaggttaggtaataagtgtgagattttgttttaaaaataataaataaataaaataaaataaaaattaaaattaaatgttaaaattaatttataaaataaattttggttaaagtagtttgtttattttgttttaattatgtatattgtattagattttgttaggggtttagtgtataaagatgagatttttgttttgttagataggtgggatgatggttatattttgagttagttaaggtattatttggttgtgtaataaaagttaaaatattagaggttgagtagtatttggatttatgttttagtttaagtgttagttgttatgggggtttaggatagtttggatttagtttatttttttggtgtatttttgatatatagtttttattttttgagttgagatggttttagtttttgttgttatgtttgtattttagttagagggaagggaagaagggagaggggaaagggtaagtgtttttttttatttttaagggtatgatttgaaagttaaatattttagtttttttttattggttagaatttagttgtatggttgtttttgttattagggaggttgagtaatgtattttttagttgggtttttttgtgtataattaaaattttagttattatagaaaaaagggagtttagatattggggaaataattagtatttgtattatatgtattgatagttttttttgtatgaatagagttgtggtaggttttatgttagggagaaagtaagattggaaaagagtttattaaggaggtggtatttgtattgtgtttaaggggtaagaaaaatgttttttaattaggagttataaatgtttggttgaagtgttattgtttttttattttggagttggaatagatgttattagttaattatgatggttgttgggtgtattggttaatatttataattttagtattttgtgaggttgagggtgggaagattgtttggggttaggagtttgagattagtttgggtaaattgtaagattttgtttttgtaaaaaaatataaaatgtagttgagtgtggtggtatttgtagatttagttttagttatttgagaggttgagatgggaggattgtttgggtttaggagtttgaggttgtagtgagttatgattgtattattgtattttagtttgggtgatagagtaggatttgtttttaaaaataataaaataaaattaaagttttaaaatggaaaaaaaattatgagtatataattttagatgtatttttaagatagtaaatttgggtgggtgtagtggtttatgtttgtaattttggtattttgggaggttaaggtgggtggattatttgaggttaggagtttgagattagtttggttaatagttttatttgtattataaatataaaattagttgggtatggtggtgggtatttgtgattttagttatttggaaggttgaggtaggagaattgtttgaatttaggaggtggaggttgtagtgagttaagattatattattgtattttagtttggagaaaaaaagtaaaattttgttttaaaaaaaaaaaaaaaaagtaaatttagggttaggtttgtagttatatggttatttttttttttgagtatggaggtagttttagaaatttgttttatattatattagtgggtagttgattgggttagtttgttagttgaattttatttgttatagttattttttatagtaaggggtattttagatatatttttttttttagggaagaataagttgtagttgtttgagtgttttatttagtggtgtgtatgtttttttttaattttgtgtttagtgatgttttgtttgtagtttgaaatttgttatagtgggtgtgtttatattataggaattggtaaatattatatattaggttttattttttgttttttattagggtaggttgttttttttttgttgtttttgttttttgtttttttttttttttgagatggagttttgttttgttgtttaggttggtgtggagtgatgtgatttttgtttattgtaagttttgtttttttggtttatattatttttttgtttgagtttttagaatagttgggattataggtgtttgttattatatttggttaattttttgtatttttagtagagatggggttttattgtgttagttaggatggttttgattttttgattttgtaatttgttttttttggttttttaaaatgttggtattatgttattgtgtttggtttagggtaggttgttagaaatgtattagtttgttagttttagttttgtttgttttttattttttttttttttttttttttttttgagatggggtttttttttgttgttttttaggttggagtgtagtggtgtgattttggtttattgtaatttttgttttttgggattaagtgatttttttgttttagttttttaagtagttgggattataggtgtttattattatgtttagttaaattttgtatttttagtagagatggggttttattatattggttaggttggtattgaattttttatttaaggtgatttatttgttttggttttttaaagtgttgggattataggtgtgagttattgtattgggttttttttgtttttttttaatgaaaatttttttgaaagatttgtttattgatgtttgtgttaataggtattgtttgtgggatagagtttgttttttttttgaaggtttttttttgtttgggtgattatttgtatgttattttttgttgtttagaattaaagatgtagttatgtttggggtaggttgggaaaatttgtgggaattatagagtttgttgttatgttgtgttttggatatttgaagtttggtaggtaggtgggattgagggtgggtattaggaaagtgatgtggttttataggaaggggatataggttttgagattttaggtttttaattggataaagttgttttttttttttggataaatgttttagtttatttataattgagtggttagtttttttttttttttttttttttttttttttgagatggagttttgtttttttgtttaggttggagtgtagtggtgttattttggtttattgtaagttttgttttttaggtttatgttatttttttgttttagtttttggagtagttgggattataggtgtttgttattgtgtttggttaattttttgtatttttagtagagatagggttttattgtgttagttaggatggttttgattttttgattttgtgatttgtttgttttggttttttaaagtgttgggattataggtgtgagttattgtgtttggttaagtggttagtttttttagttgttgggttttgtatattttgttggttttggagattatatgtattatgtagattttatttgttttttatttttagtgttgggggaggggttaagggtttgttgatgtgttgatatttggttatttattggttttgaatgtttatatttatttttttgaaattgatgttttgtattggaggttttatgtggatttgggggtagaggtttgtattttagatggtggggtggtttttattaattaggtagattttttgttttgttttgttttttgggttttgtagttttagatgtgtgtttaagatttgtggttatatggatgggataagttatagagatttagattttgtggtttttgtgattagagtagttgtggttttgtttgggaatgtttttattttgttgttgaaggtgagaaatttttttgtgttggagaatagttgtgttgagaagttggtttatttggtttgtaggattgttggggtaagggaggtttgttgttggttttttttttttttttttgattgggtgttttttgtttaggttttttgtagtaaaagaattttttaatttattttgtttttttattgagtttttattttatgaagtttattttttaattttagttgattggtttttatttttttaagaggaaggttaggggtagatgaggttgaaggaggttgatttttttgtgtttttgtagtttgagttgatgttgttgtatgtttatagggtttttttagtttttaaaaaggttttaatatgtttgttatatgtttgtggtttttttggatgttatattaatttagtaaggtttgagttagaggttgtttttgaggttgtgaaaatagaagaagggtttagaggagaatttttttatttgatgattttaggaaggttttttagaagaagtagtttttgagttgagatttgaagatagattaggtttgagttaggttagggagggtgtgaggggtttattaggtagagggaataggatagggtaggtatagaggtttggtatttggtttgtggggaagtgtgagtttttgggtatgattaaggtggggagaagtggtgtgagaggaggtagatgtggttggtaggagattggtggttttggttttgttgagttttattttgtatgtattaggtgatagaggttgtttaggatggtgggtagggaagtgataggttatatggttattttattaatagttgggagtttagtttggggggatttaagattttggggaaggtatgagttaggggtttgttagagttaggagttagtgggagaaggaaatagtgttgtttatgaattataaatagatatttttgtaattttttttgatgtgatataattttaaagtgggttatttagaggtgggaaggtgatttttggttttttaggttttgggtttgttttttttttttttttttttttttttttgagatggagttttattttgttgtttaggttggagtgtagtggtgtaattttggtttattattatttttgttttttgtgtttaagtaatttttttgttttagttttttgagtagttgggattataggtatttgttattatatttggttaatttttgtatttttagtagagatggtgttttattatgttggttaggttggttttgaatttttgattttaggtgatttgtttattttggttttttaaagtgttgggattataggtatgagttattgtgtttagttgagtttatttttaagttttttttggtttttagtgtttttgtattagtttatttttttggttttttgtttttaagagttttttttaagattgtttttaagtggataggtttttagaattaaggagtagttttaggagtttttagttatagatattttagggggtttgtgtggtttttagtttttggtttggttttggtagttttggttttttgtgttgttttttatatagtttggttagagttggttaggttttttggttgggttgagttattgtggttagtgatttatgtagggggagaaaagtgaggagggggaatagagtgtgagggggattgtgttaataataaatttattaggtttttgaggttattttataggagggataaatggtttatttaggttgatttggttgttggttggtttttagagatatttagggtggggaagattttattatttggggaaagtaatattagattgtttggaggggtttagttagtgtattttgtgttttttgtttgttttttatgtagagtgttttgtttttaaggtggtaggttaagagtgtgagttgaggtttaggtgtaaagaggggtgtggtatgggggtattgtagggtatggggtgtatgtatttttatttatttttttattgagtgttagggtaatttgttaatggggtatatttggtgatataaaattttttgttgatttatggtagtttggaatggagtggaagtgttttatttttggggaatttttatatatatttggttgtgaatgttggtgtttttgtattggagtttttttggagtgtgttgggtagagtggagaggtttttttttttttttttttattattttgtggaggtgttaatatgtagttagagatggttagtggtagtgaggagaggggggtaggaagagattagggttgggggtttgttagtttatagttttatttttgaatatttatggtttttttgtttaggttagtgaggttgggggtagagatgggtaggggttttttaatgttgggtatttttttgtttttttatattttggatttgttttttggagaaagttttggagtatttagaagttttggggttgttggttgaggtggggagtagagtttagttgtgtttggaggttttttatttttatttagtttttagggatagttttagttgtgtaggtttaggttgttgaggttggttttagaaatttttttataattattattggatggaaaattagttttttaaagggttttagagttagttttgtttttttttttataggtttttatagttagagtattgggtttttgttagagatgtagaagagatgatgtttttagtttttatgtggtttggtttttattgtggatgttggtgattttagttttttttttaaaattaagagggttgatgttttatattttaggtttttagaaagagttgttatttatttatattgttatattttttttttatttttttgttttggaaagagtagagtggatatgtgtttttgtagaaatttatttatagtttgattgtagatgtattttgtttttttattgagtttttgttttatgaagtttgttttgtttgtattttttttttttttttttttttttttttttttttttttttttttttttgtttttttttttttttttttttttttgttttattttttttttttttttttttttttttttttttttttttttttttttttgttttttttattttttttttttttttttttttttttttttgaatagttaaagatagaatgaatggtataggtaggtattgagttttttgtaattggaggtgtttaagtgtagggtggatgggtatttatagggtaggtattgaggaaggatttttttgggattgtggatggtaggataggttttgtggagttttttgagtgggtgtagaagagggagggtatgtttttgttttttgttttttttgggttgttaggttgttatttttaatttttattttttttttttttatttgttgggttttatgggatgggtagaggtattgttagaatatggagttgtggtttatagagggttagtagggaggagagttttttggggattatgttgttttagttattgtggtgattttgaaaataaatgtttttttttttgtttgagtttttgttgtttttgttgatgtggaattagggtaggttggtgatttagtttttatttttgtattgtattggtggtaagttgtttttagttttagattttatagagtagggtgttttttttagaaaaatagtagggaggttaggatattaagggttttagggatagtttgttttttttggttggtatgagttttagttaagttttttggtattttgggggtgaggaggtattagttgtgtgttttagttattggttgttttgaggttgggttggtgttaggttggttatttttttttgttttttagtgtgattttgtagagtttttggaagggttagagggtttttttttattattggtgtttatgggatattgtgtttttattttatttttgtattttagttttagatgggtgttaggaagttggagattttagttattttatgattgtgttttgtggggttggagtaggaataggagtaggaggaatgttttggttatgggattgtgtgaagagagaaggattaggaagaaaatatgagttattatgtttgggttatattttagtagagttgttggtggttttttaggtatttgaatttattaattataaagtttattaggtgtgtaaataaataaatgttgtttaggaggtatagttagggttttgttggagagggattattttggaggggttatattttttatttagttttttagtttttttgttttgtgtgtgtgtagtttttgattattattatttttgtttttgttatttgtttttagggttttattaggttggatgttattgtaataaaatgtagtaatagaaggtttaggtagtgttgtagtttttggtggtattattagagttagtaggtagtagggttggggaattttaagttgatttagttttaagtgttggagtggggagtttggatgaggtgggggtggggaattggggagttatggagtagagtatttgttgtgttgaaggttaggagtttttttgggagattatgaatttagaatattaatattttgtttaaaaagttttttgttttggagataagagtttaggttgttgtggttaggttttgttgtaaatgttttgtataaagtaggttggggggattattgggaagtttggggaatagattggttatgtgtttttttgagtgaaattttatggttgtattgaagtggttaggtagagggtgtgatggggtgtggtagttgtatattggtttagttaggttgaatggggaaatgtaaatttaggtggtttgaaagagatttagtggtttatagtttggtggttgtttttagtataggtgatgtaaagagagaaggggttttgggggtttggtttaggtggaaattatgtattgtttgtgattttgggtatgttgaggttggagtaggtttgtttggtggttggtagaatgtatatgaagaatttatgtgtgttttgaatgttttttttgtttttttgggtttatgttttattaggagttttttgattttgttattttgtaaaggaaattgtgttttgttattgtataggattgaataggtgtgtgtggagtttttaaagttattgttttaaggggttttatgggataatgggagagttgttgtgatgtttaagattaaagtgatggttgggtgtagtggtttatgtttgtaattttagtattttgggaggttgaggaggatggattatttgaggttaggagtttgagattattttggttaatatggtgaaattttatttttattaaaaaaataaaaattagttgggtatggtagtgggtgtttgtaattttagttatttgggaggttgaggtaggagaattgttttgatttgggaggtggaggttgtagtgagttgagattatgttattatattatagtttgggtgatagagtgagattgtttaaaataataataatgttaataataaataaaataataataataaaataataaaagtaaggatttgaataaatatttgtatatttatgtttgtagtagttttatttttaattgtttaaatgtggaaggaatggatatataaagtgtgtgtatatatagtggaatattatttagtttttaaaaggaatggaattttgttattatatgtgaattttgaataatgaattttgaagattttatgttatgtaagtttgttttataaggataaatattgtatgattttatttatgtgaagttaaatttatagagaaattggaatgatggttgttagtagttaggggaaggaaggatggggagttattgtttaatgaggatagagttttagtttgggaagttggaagaagttttggaggtggatggtgttgatgggtgtataatgtgaatgtatttaatgttattaatatggaaatttggttaaaatggtaaatttgttttttttgtttttgttttttttttttttgagatggagttttgttttgttgtttaggttggagtgtattggtgtgattttggtttattgtaatttttgttttttaggtttaggtgatttttgtgttttagttttttagagagttgggattataggtgtttgttattatgtttggttgatttttgtatttttagtagagatagggttttattatgttggttaggttggttttgaatttttgattttaggtgatttatttattttggttttttaaagtgttgggattataggtgtgagttatggtggttggttaaaaatggtaaattttatattatatatattttattatagtaaaaatgtattgttttattagaaaaatgatagatttttataatatgaattaaattataagttatgaaggaaaaattaagtaaaatattaaaaaattatttataagtaattatatttaaaataaaagataataaatatataatttttattattttttaggttttttgtaatatttaattattgtttgttttgttgtggttatgtttttgaggttgtatttgtatgatagaaatattatatttgtggtgattaaatatttttttttagttttatttttaatgatgttatatagataatttgaaattggttggttgggtatgatggtttatgtttgtaattttagtattttgggaggttaaggtaggtagattatttgagtttaaaattagtttggttagtagggtgaatttttatttttagtaaaaatataaaaattagttaggagtggtggtgggtgtttgtaatttgagttatttgggaggttgaggtaggagaattatttgaatttgggaggtggagtttgtagtgagttaggattgttttattgtattttagattgggtgatagagtgagattttgttaaaaaagaaaagaaaagaaagaaattggttaaggtaggaatattgatattataggaataggtaagtgttataaattgggaaattgagtgttgttgtttttgttggttttaggtggttggttgttgattgttaattggtatattattggaggagggaggtttagattgatttgtagagagattagaggtagaaatgtattatggtttggatgttgagggtgagggaaagagaggagttaatagtggtgtttggagatttggtttgagtaattaggtggatggtagtattgttttttaagatgaggggttgtgggaatttgaggggttgtggaaggttttgttattgatggatttagggtttggtagttttgggaggtttattttgtgttaggttatgtagagataagattatttgggttttgtttttgggaagtttttgtttatgaggatatagtttgttatttaatggggtgttttgtttggagttttagtgttgttgggagaaagttttttatttttttttgttttttgagttttttttgtttttttgttagttgagtttttttatggaggttgtgtttggaggggggttatggatatggatgtgtgtgttaaatgttgtttttttgtggattttttttttattttgtttttatgttttgtaagttttatttttttggggtttgatttgtggggtttttttttagatttgtttttttttatttttagaaaggtgtgtaggggttttttatggtttttttttttgtttttatttttttttttttgggatagtgatttgttggatgggtgggttatttatagggtttgtgattgtttagatatttttgttgtatgaagttttgattttaaggtatgatgtagatgggaataaggtatgagttttttttggttgttgtaataattgttgaaattgggtggtttatagtaaggggaatgtgtttttttatagttttggaggttagaagtttgaaattaaggtgttagtagggttagttttttttgaagattttaggggaaaatttttttttgttttttttagtttttggtggttttaggtgttttttggtttgtggttgtattattttggtttttgtttttgtttttataaggtttttttttgtgtttttgtatttttttttttgttttttagaaggatatagtattgaatttagggtttattttattttgagatttttgtttaaattttttttgtagagatttttaaatagaattaggttatatttgaggttttaagtgggtatatttttgttttgggggggattattggtttattgtaggttttgttgtgtattgaagatgtaggtggtttttttggttaggtttgtagttggttttgtttttttttgtgattgtggaagaatgtattttgttggatgtataggtttttatagtttttttgtttttgttaaattttagtttagttttttttttgttgttggtgtgtattttttttgtttagtgttttttttgggattgtgtgtttaggttttgaggttttagaaaaggggggtggagggtttttttattattttgtagtaatgaggttttattaaaattttggagttttagattggatttagtttttagttatgattaaaggatagtttgggatatgattaaagggttagagaaagatgatttaggttgagaaagaggaggttaaggagtaattggattgtttttgaatgtggaaaaggtaattatgatttgaagggtggtgtttagttgttttttattttttttgaggataggaaaaaaaaggaaataaatgatgtataattagagtagttggttagatatgagggtgaattttttggttgggagtatggttaagttttgatttgggttttttgaaagagtttggggaatttttttatttggaggtttttaggtttggttatgtggttttgagtgattatattgaaggggtagtggttggggttggagttggtgggttttgagtatagttatgaaggtatgtgtattttttggttgtttttttgttattgttttttgggtttttattttggtgaggtgtgtattttggtggtgttttttagggaattaaatatgtttgttgtattgtgtgtggagatggagaatgtataattggttgattttgtgttaatttggtggaattttatgttagttttgggaaagaataattgtatgggtgtgtttatatttattaggtgttttttagaaaaatatttgagaataatgttgtggtttaggatggttgttgtgttggatttggtatttttttaggggggttgtgttgttgggttgagttttttaggtattggatttttaaatttttaaatatggtgtggataggtggtttagtaggggttggattatttgataggtttaggtgttggagtttagataagatatattttggtttggtgtggaagatatggggtgttattaatggtagtaatggttgtatttttgaaatttgggtttttaggttgatgagggtgtgtatgtatttgaaatgtttgtggttttgtagtttttatgtttataaatttatttggttgaaaatagtttaaaatatttaaagtatgagggagggagtgtttgttttttttaaaaaggaaggatttgattttatttatttaaaaagttatttaaatttagaatattttttgtaagagattttttgttttttgtttttttagaatggttggagagttttagtatttttgtatatttgggatattttagagggggtggggaggggtaagtgggtagtgagtgattttagatttaggatgagttgttaggtgttttttggttatatatttaagggattggagtgtagttgtagtgttgtggtttgttgttttgggggtgggggtgttgttttatgttgtgaatttttatatggtttttgattttgggtagaggttgagggtttaagggatggggtgatagggagagtatgtaggagtgggtttttggttttttagggtgagtggaagaagtgttttttttttttgtaggtgatagatttggggggttttttttgaggatgagagtttgttgttttttaagttttgtgtttaatttaggtttttaggtttattttagttttttggttttgtttgttttgtggatgatatagtttaagggtagagattgttggtttggagggaaggttaggttttaggttagggtttagaagggagggagaagtttttggggtagttttttttttgtttatttattgtttagtttttttttttatatttttttttggaaatgtttgtttttgataaggtttattttttgtttttaggaggtttttattgtggaggaagggaggtgttgtttgtttttggtttttttgatagttgtgttttatttttgttttgtgtttttttttttggatagtgttttttttagggtttatttaggagggtgtagtggtggtttttggggtggtggttgtggtgggggtgttagttgtaggggtgtttttggtgggtgggagttggtggttttttgttggtgttatgggatttgtatgtttgttttgtgttttttggtttttgagtttataggttgggattttgtttgttagttgtgtgtgttgttgtttaatttttgtaggtgtagagtgtgtggtggtggtgatagagaattttgtttggttgtttaaatatagttttttgtagaaggattttgtgtttggggaaggggaggaatttttttttttttgggtgtttgttttttttgttatggtttggtttttatatttgtttatatttggttgtagtggggtgtttggggggaggggttgaggttgtgttttttgttgttttttgggtgtgggttaggtggggaggaggggggtgttttggttgtgtgtttaggattgttttttagtggttatttgggttttagttttttaggtttggttttgataggtgggtggagtagttagtgtgagatagggaggttggtgtgggtgtgggaatttgatttgtttgggaggtgggggtggggtgggggtgtagtgtgtggggaggggttggtgtttgttttttttttttatttatttagttgagttagggggtttaggggtttttttggtggttagttttgtattgtaggagtgtgggtgtggtgttttagttagtgtgtagggtttgggttttgttgggggtgtttttttgttgttgttttttgtgtgatttgttgtttattagttattatgttggattttgtggttaatgtgtagttggatgggattattttggattttgaaggtgggtgttgggttggttgttgtggttgtggatgtgttggagaggattttgtgggtgggtttggtgtgggatgggggtgtgttgaggggagatgggagtgtgttgaggggagatgggatttttaatttaggtgtttttttgttgagagtgttgtgtgtttttggttttgtgtttgtgttgtttatgtgggggattttgttaggggtatttgtgtagattttgtgtgtttttataggattttgtgtttgttttgtgtattgttgtttgggtttttttttttttattgttgtttgtgtttgttaagtgatagtgatttttttgagggtttgtgaggttgttttggaattttttaggatgtatagttttattttgggaaatttattggttttttttttttggttttttttggtggtttttgggttttgtttggatttggtaatgggatagggaggttgttttttatttttgattgagtggatagttgtgttttgtttgggtggatagttttttttttttttatgttagttttggggttgttaagttgtgtagtttgtgggttgggagtattgaatggatatagtttaggttgtggtagggtttagagtgggatgttttatggtttttatttaggtttggggatatttttatttgttttttagaattgggttgtgggggatagaaggggtttgtgtgtgggtagggagagtattttggtttttttttgtttttggggtttataaagtgtgttgggatttgtggggttgttttgtttaagtttgggtttggtgtttgtgtttttgagtttgtgagtgtgtgtgtttttttgtgtttttttgattgttggtgttggggttttgtgttttgtgtttgtgggagtaaatatagtaggtgaaggggaagtttatataatggtttttagtgttttggggtagggtttttgaggggtgggtttgtttttgttgggatttggagtttttgttttttggagaggtttttaggttgatttgggtagagttttttggtgggttgggagggggaaaggttgtgttgaaatgagtaaattgtttaggtgttaggttaagttgggaggtgattagtttgaggttttttttgttttatggttagaattagggttgatatttgggtgttttgagtttagttgtttatatggtttatttggggttagttttatttgagtgggggaggtggggttttttgggggattagaattttggttggatgttaagtagagtgttagtggttgttttttagggttgggtttgaggagggtgtggggtggtgaagggatgggagggggttgtgatttagtggttattggtgttgtgtagagtgtgagttggaaatattgtagttattttgttagtttagtggtgaaagtttttttttaggttttatttttttgtatttttgttttttagagggaggggaggtttgggtttgtagagttgggagggtttgttgtttttgttttttttttttataatatttttttatttggatatttttgggtatatgtttatattggggtttttttaggtttattgtgttttgttgagttttttgtagtttttgagtgaatgtgatttttttgtttttgtttttttgtaatttttttttgtgattgtttttttaggggttttttttgttttaaatgtttaagtggtatgatttagttggtttgattattttttagtaagtttttatggagagaggttttgtgttgtgtagagttttttttttgtttgtgggattgaggtttttgtttttagtttttaatagaaagtgttgggtttttagtgggatttttggggaagaatttttgtgttttaatgggagttttgtggtgggaggggaggttagggtttggggttgtgtttgttgtatagttgttattatttgtattatgaaagttgttagtgttttttttttgggtttttgggtgtaattttatttttgtttttatgtgtttttatttggagttgtttttgtggttgttttttaagttagttttgtgattttgtaatttagtttaagataatgggtttattgagattattttggtgtagtagttggtaattttttggttttgggggaaggttttttagttttggggagtggggttttaatttgttggttttttgtgtttattagttttttttttgtgtgttttgaatggttttgttgggaattttggttttagagttattaggtggtttgagttgataggtgtgagagagtgtgtgtgtgtatgagtgtgtatgtgtatgggggttgatttggggtatggaaaggtggttttttttggtgtttaaggagtttggagtatagttggagggtgtgggggtgtgtatatgggagttggataattttgggtggatagatagatgtggggaagggatgattgaaggaggtggaggagagagtgtgatttagtttagttaggggtgatgtggataggtagtttttgaattagggtagagaaaagttattattagttagtaggggagaagttagtatggaggaggtggattttgagggagagtaggaattggattgtaagaggaaggagagttttttggttagtagtagttagtagtagtgggggaggttggaatgagttggttggagagggggttggggtataaggaggggtttgtttgtgaagattatatgggttaggttgtggagggttaggtatgtttgttgggagtgtagttggtttatgggaagtatttggagtggttgggaatgggtgtaggagtagtgttgtgggagtataggttttttttttggggtggtttatttggtgttttggtttttgtaaggtaggttgaaagggtggggaggaaattgttagttttttatagtgttgggatggtggttttagggtttttgaggttagtggatgtgggtgtttgttattatgtgggttgttgaggggtggagattttaggggttattttaaagtaggatgagttttgagttatggtatttttgggggtagttttttaattgagtagatgtttaggtttggaattttgtaatagaggttatagggttttgattagggtgttttgggaggtttagaattagtggtagtatatagggtagatggtaagtgatttggtatggggaaagaggtaggtgtttaggttggtatagtatatttgtaaggaataggtagatgggaagttgtttgtgggtttgtgtgtgtgtttggagttaaaattttgttaatgttttatgttttgggtatatttattttttttttggggagtatttttttttttattttttttttttttgtttgttttttttatttagggttttttttattttttttgttttggggattgagggtattatggttttatgttttattattgatgagttgtatagggatttagtttttttgttgtttaggttgggttttttaggtttagggtttttaggaatggagagggtattagtgttttttatggatttaaattttttgtattttgtttttgttttttttttaagataggtttttgagttttaaggttttagggttttgtggaggttgttatgtagtagtaaggagaatgttttgtatttggttgatgagatttttagagttttattttttatttttttattgtataaatgggtttttaggtgattgtagtatttgttattgtttgtaatagggtgataagagggatgattttttttttttttttttttttggttggtggaggtatggggttggtggatggtatgtgtttttgtgaatttaggttaaatttgttattgtaaatatgattataatttgggtttttgtgtaataaaagtttttttaagtattagttgttggtttgttttgtttagtggtgtttgttgtaattagatttgtatattgagaaagaatttaaaagtttttgatgtttgttgaaataatttggtttaggatttatgtgtttagattttagagttgtgtggtatttgagttttttttgagtttttattgttgtttgaggaggatttttagatttgtgttttggaggtagagtaggttgtgggatgggtttttgggtgggaaggattatgtggatatgtttttttgtttgagagttttaatatttttgggatgtgggagttggtgtgttggtaggatttaggtgttttttttttttttagagaaaaaggttttgttgtttggtaataggtgtagatttgtttttaattaatgttagtaggttttttgtgtgatgaattttgttttttagttaagatttaaggtattttgtgaatattgtttttttgtagtttgagtttttgtggtgggaggtaggagttatggggagtgggggtaggttttttatatgggttttatagttattggtagtattgatttgatgttttttgagtttagagtttagggttagatagatttattgttttgattatgagttggtttatttagaggggggtggatatagtatttaggtagtagatgtattgtgattagttttgtagtggggttgtgggttttttgggttggatgtttgggaagaggtaggtggaggtaaatgttaggatatttttgtagtgattgggtgattgtaggttggaaatgttttttgtgggttgtggttgtttaggaaggttttgaatggggttagtggatagagtttgtatttagaggggtagtgttttggaggagtgaggggtatggtagtgtagggatgtttaggttgtttttattttgttattggaaagttgggtggttttggtttttttagtttttttgtttgtttttttgtttgtaaagtggggttagaaatagttttttttgagggttgttgggggattttgagatgtagtttatggtgttgagtatgggttttgttttttatgggtgtggtgggtgttgtggttggtgtggtatttgggtgggaaaagggggtatttgtaaaggataggtaggtttggatgtttaaatatgtagatttggggatgggaggttttaggtaagggtttgtgtgatgttattgtatgaatgaggttggatagtatggttattattaattatggaaagtatggtagatattagtgttagtagtgtttgtttgggggtttttttgagtttgataggtatttaggtttttagtgtagttatgggatttttttttttttgtttggttgatattttggaggttggtgttatgttggttgtaggttttttttattgggaggttgttttggttttttttgttattatttatttttatttttattttggagtgttatagatgggtggattatatgtttatttgtagggttaagtgttgataatgaggtgagtatttgttggatgattggattatgaggatagtgggggtgttggtagtttgtgtttggttttgtaggttggtttttttttgaaaagtggttgtggtagagtgtgtattttagggagtggtgtttgttgttttgaatatttttatttagtaggtttttgtaagggtttagttaagtgtggtgtagagttgggttggtagttggaatagttttattttgtttagtggtgagattaagggttgatgggttaaggttgtgtgttgtttgtttagtttgtggatttatttattgagtatttttatatttttatattgggtttggggtgttaggaggtggaggggggattgggtgtttggaaaaataagtttattgagagtttgagtttttaggggttagtattaggtagttattatggtgtttggtatatagtggttatttggttttgttggttgttttggtggtggagagtgtgtatggtggttgtatgtgatgggtattatttagggtaatatagatatgtagattgtgtatttgtttgtaggagttagggattttttagtttggtaatttgtgatttttgtttatttgttgggagagaggtgttgttttttgatagtttggtgttgggagagtagaattagggttttttttttttttttttattttttattttttatatgtttaggtattaggggaggttatatttagggatgagttttggttattgggtttagggttttattgttgttattttttttttttgttagttagttaaatgtttgtttattattgtgttggggatggggttggtttgtttttttgaagtttttttggtgtatagtttaggttggagttttggatgattttgttatttttttttttgattttttttttttattttgatttattttagaaatttagttaaaaattaagtttttgtgtttttttttgataaagttattgaggaaaaatggttaaatattgtttttttttttaaagtttttttggttttttttaaatttggaggttttgagttgtttatgagattaaagggtttggaattttttggaatatagttttagaagtgggaggatttgttatttttttagttaaatagatttattagttggtttttagatatttttaggtgtttggggtatttttgggtttaggttgtttaatttggtttgtagagttttgaggttttgtttagattgggttagtagatagttttagagattttaagtttgttgttgtttttaaaagttttgttaatgtttagaaatttagagggataagaagatgattttgatgttagttgggattataaatagtgaggtttgtttttttttttatttatgtttgtttttattgtttttgtagttgggtttttaggggattgtttgtggttatgggggaggttgggaatgtggggtttagattttattgggttttttgtatttttttgtttttttttgtttatttttttttttggaaatttttgaatatttttttatagtttttggtattttgttatttttggtatttttgggttaattgggaaagttattatttgtttaatatttagaaaattaaggggtttggttttaaatatattgtagtgtttttttttttatatggtattgaattttttgtgtttttaaagttaggagtttgtgttttggatgtgggtgatggagttttgtagatatttggagtggtttttttgggagagttttttttgtttttttatttatttgtttttttttttttgttttaagttttggttatagttttggaggggttatttgagtgtaggttgtttttaggtgtatagttggaggggggtagttattttatatttttttgtttgttaggggtatttttagggatttaggttttgagggatagtggaagggtggggtggggagtaggttgttgttttgtgttatttgggtgttatgtagattttgaatgggtagtttttgggagttggttttttttttttattttttttatagtgttgtttttttgaggggttggagttttttggagttttttgtagtttgtggtaggtttttttgattttgtgtttggttttgtagtttttaatttatagttagtggtatgaagaatatttttggttgtttttatttgtggtttttgtaggtagtagttttttggggtagggtttgggggttttggtatttttttgtgggattttttgggtatgagggagggagttatttgggttatagatagattttttttttgtatttaggaggtttaggatggatttgttttatttttttttttggtgggaagagagtatttttggttatggggaatgtggtttggatagagttatttagtttttttttttttttaggtagggttttgaaagatggagatggttttgtttttgttaggttaatagttagtagtttggtggatttttatgtagtttaggtaggatttttttttgtttttattttttattttatgtgtaggaagttggttttaagtagggatttttggttttgttttttatgtgggtgggtagtttttttgtgaggggtaggttaggtttttgttttatgttttttagagattgatgttatttatagtaagagtatataagtttttttggttttaaattaggtttggaggggtggtttttttttttgttttttgttttttgttttttattaaaggttagggaatggagtgttttgtatgtttgttggggttgggtttttttttttggtttaaaatgaagggttggaatttttggtgtagattgtatggtgagaggtgttttttgggatttatttgaggagtattattgttgaatgttttgttaggttaggagtattgttgggggtgggagaggtagttggtttatttgtttatttaatagttatttatgggtattttaagggttagttttgttttaggtattgggggtttaggtatgggtttaggagaaggggtagaatgggagggttttttggaggaaggttttttaattagagattggggtaggagtttgttaggtaggtgatgttggttagttttttttgttattttttttttttttttttttttttttttttttttttttttttgagatagagttttgtttttgttgtttaggttgtagtgtagtggtgtgattttggtttattgtattttttgttttttgggtttaagtgatttttttgttttagttttttgagtagttgagattttaggtatgtattattatgtttagttaattttttgtatttttagtagagataaggttttattttgttggttaggttggttttaaattttttattttaggtgatttgtttattttggttttttaaagtgttgggattataggtgtgagttattgtgtttggtttttttttgttatttttgtagatttatagtgtgtgtggaagattgtatgtttgtgtttggtatagttgtttttggtatttaggtgggaggtgggggagagggttgttggtgttagtataggttatggtatgagataggtttttgtagttaagtggggtgtattgtagtattggaggggttttgttgtgtatgagatttaggttttgtatttgtttttttttttaggaggtttggagggttgggagggattagggtggtgaaataatttaggtgggagagaggtattgttggagaggtagagggagttgtaggtttgtagtagtgagttttaaattttgggtttttattagaaaattttagaaagggttgttttgtttttttttttaaattataaaagaaatttttggttgtttgggttttttggggttgggtgggggaggagattttttatttgtatttttgtaggtttagtattgtgtagagggaggagggtggaggtaaaggtgagggaggagggtggaagtaaaggtggggtttttttttagttttgttgttttgtttggttgttgtttttagatttttatttttggtttggaaatatggaattttgggatagttggggtagggggtatagaatggagattttggtgagggaggaattttttttttagttttggttgtggttatagtaaggttaggttgggaggattttatttaaatatttatattttttttaatatttaaatgatgaagtaggtttttgtatatagttgttttggagttagttgttgtttgttttatttttttttttttttttttttttttttttttttttttttttttttttttttttttttttttttttttttttttttgtattttttgtttttgatttaagtttaggtttttttagttgttttttttttatttataggtattttttgtgattgagtttttttttgttattttttataattattttttttaattgagtattttttaggtgttaggttttgggttggtattttgtatataaggtgttttttaatttttatgagagtttaataaggtagattgggttgttgaggttttagtgttggaaggttggtttgggtttttttagtttgtatttgtatttatttattatttttttattgtggagatttgttttttggtttttggttgagtatgatggaaatttttgtttattagtttttggagagtggggatggttgagggttttgattttggggtttgatgggggttgtttttgttttattttagtttggttgtttttttatttaatgattgagtttgtaaaattagaataatagtgttatttggttggtattttgggtggttgggaggtgtgggagagggtgtatggaggggttgagtgaggtgttagtattgtggggatttttgagggtagtttttttaggtttagggtggagtgtaggtagagggtgtgatggtttagtgtgttggtttatatttggttttgtttttgtttatatggtaatgtgggggagttattagttttttagtgttttagttttttatttgtgtaatggggataagagtaaattattgtttttaggtatggtaagtatttatatatattgattattgtagaatgaatatagtgagttttttttaggtttttattatatgttaggtagggtgttaggttttagtggagaggggataatgatgggtaagttggtttttgtttttaagggttgttgagtagggaggaaggtggtggttgttttgattgtgatttggagtggggtgatttgtaaagaggttggtgggaggttggttgggggttggttgggggttgtttttttttttgtttgtgttttgtggtagggtattaaattggttttttttatggatttttgaggttttgattgtgggattttgggtaggttttgggattttgtgattttgtttttgtttgttatttaggtttttgtttttagtagtgtttagtatatggtgatttttgtatgttttttagtgtgtgattgattttggagttgagatttggtagttgaggttggatattgtttttggataatttttggggaggtgggggtagggtggggttgtgagttggtaattttgagtttttagtagtttttgaatggaggttttttttttgtaggatttttggggaggaaggaggggatgggggagatgaggtttgtgagtttttaggagggtagaggtttatatttgtagtgttttagaaatattttggggtgtttaggtttatttagtttttttgagttagaattattaagagttggggattagtagtttattttttagtaagatttagaaatgatttttttgaatagtttgagttaagaatgatatatttggaattagaatattagaattatagaggaattgagagaatgggtttaaaatgtgtagggattttagttatatggtgttatatggaggaaagtatttaatattattattgtatgaatttgtttaaatatatatatatatatatatatatatatatatatatatatatatattttttagtaaagagtggaaagatatttgttagaatattgatggaagttatttgggttgtgggtttatagattttttttttttgtttttgtgtattttgtaaatttttggttttgtgtttaaattttttttatagttaggaataaagtaatagatgttattttttaaagtttatgggtttgtgtttgtaattttaatattttgggaggttgaggtaggaggattttttaagtttaggagtttgagattagtttgggtaatatagggagatttttatttttttttttttttttttttgatagagttttattgtgttttaggttgaagtggtggtggtatgtttttggtttattgtaatttttgttttttaggtttaggtgatttttatgttttagttttttgagtagttggattatagatatttatatttgtaggatttgagaattttataagaggaaagtttttatttggaggttgttggggatttggagttgttagtttatatattttttagtagagatagggttttattatgttgattaggttggttttaaatttttgtttttaagtgatttatttattttggttttttaaggttttaggattataggtgtgagttattgtgtttggttatgggagatttttttttaaaataagaataaaaataaaaataaataaaagtttattgttaaaaagaaaaatatattatttaatttaatttttttttaggattgagagatgaggaagtagaggttggaaagtgttatattttttggttgttggtagttaggggatttgaggtttgggttggtttttttgtgttttaggtttggggtgttaggtggagtttttgttttgtttaaaggtttaggtgtttttgttagtattgtttgtttttgtatttttggttataaggaatgtgggttaaaggtagggtttttgatttttgtttaggagggtgaagtgggttggttttttttgtttttgttttaaggtttttgtggttgtgtttttggaaattgttggtttgagttagtgtgtggagttgggatagattttattgtggtttttgtggggttattttatgtttgggttggaagggattttttggtttagttttttttgttttttattaggaaattgagattagagaggttatttgtttggtttggggtggggtgtagatggtgtttgtgatttttgtatgttatgtgtagatagttttttagttgtgggttttttatgtaagtagttatgttggggataatttggttgaaatttgtgatttaatgaagagaagaatgattttttttgtagttttgtgttttataggtttttttttgtttttattttttttgtagaggggttttatgttggtgggtgggtttttgttgttgtaatgggtttaggtagtttttgggtagtggaggtttggttgtttttttgtttaatgttttttgtagtttatgttgtttgggaagggtggggaagtatttagttattggggattttataagatgggtatttgggagatgttgattggtaggttaggtttttgtggtttataggtaggttagaggttatagtgttgagttgggttgagttggtagtttagggtagtgggggtgggggtattttgtttagttatgggtttttttggtataagggtttggagtttattgtaaataatttttttagttttttttttttttataggttattagtagaattgaggggttttttgttgatgaggtgtggtttgggaggggttagttgtttgtttatttgatttttgtggataggtgattataggttttttgttttagggggttgggggaaagattggggaggtttttttggtttttttatttggaaggaaaatatgggtataggggagatattttatagggatatattttagttagtattttttggttgtgttgggggtatagtgtttgttttgtttataagaggggttagttttttttaggatttaattttagtttttagtgtagggtagatgagtatttagaggtttagaggatttatattatgagagagaagttgtgattatataggtattgaaggttaagtagaagagtgggatatatgggtgatttgaaagttttagggttagtgtggttagttttagatagttggggagttttgggtattaggtttagtaggggaggagggtttttgtgatagtttgttggggttgttgtaataaagttttatgaattttgggggttgaagatggttttagaggttagaagtttaaaattaaggtgttgattaggttgattttttggggtttttgtgggaggttttggtttaggttttttttttagtttttggtggtttttgggtgtttttgggtatgtagatgtgttatgttattttttgttttgtttttatatggttttttttttgtgtttttgtgttttgtaaggatgtttgttattgtatttagagtttattttaaatttaggatattttttttttgagattttttattgtatttgtaaagattttattttaatttttgttatatttataggtttgagggttagggttttggtatgttttttgggggttattatttagtttattgtggtagttgattttaggggaagtagaatgttttaagtttggggtgagtggagggaatgttgttgggtggggagtgggagattaggtttggagatattgtggattttttttgtttgatgagggtgtgatgaggtttttattttaggttttttgaatggtggttgtttttgaggagatttttttttttggatttgtttttttagaaatttttatttaggtttaggttttaaggtggatggtaagaggtggttgtttttgttatatttgatgggtgagtgtgtgaatggggttgggagtaggatatttgttatttttgtggatagattttagaggtttatgaatttgttgttggggaaggtgtttgatttagtttgattttttatttttatttttttttttttgtttttttttattagttttgtttttagagttttatttttttaaaggtaggtgttgttttttggattttttagtagttattttttattttagattttttttttgtaggtttttttggttttagtgtttatttttttttgggtttttgtttttttattgtgaggtttttgggtagaagtgtggggtttttttgttgtgtttggtttttgtggtatattaggggtttttttaggggtttgttttgtttgttaggtttttagggagttttttaagtttttagatgggtttgatggagttttttaatgtgttgttttagagtaggaggggttttggttgagtttgagagtttttttagttatattttgggttgtttggggtagttaggtagtttgttttttggaggtgttgtttttttttggttattttttttggaattttttgtgtttagttgtggttttttttatatagtatatttattatttttttttatttgtgatttttttttgttaatttttttatgtttttgagaatggagattaggttttttttattttggagtttagtagaatttaaattaggtagatttgtgtaggtttatgtgggggttttgtggttattgtggttttgttgttatttttagtttagtttggtgtgttttggattatgttatttagtgttggttttttaaattttttttttggttttgtaggtttgggaagtagttggtttttgggtgtagttgtgattggagtttgaattttgttttttggggttattgttttttgtaattaggttgtagtttatattggtttgggtagaggttattggttgtttgttttggggttataatatagagagttttgtgattaatggaggttttatttgggttaagtggtttttggtgttaggtgtttttttttttttttttttttttttgtattttttaagtgtttgtaatattttttttaatggataatgagatgaggagggagggaggggtggtttttttgtttaggtagattaggaatggttattgtttgtgtgtgtagtgataggtttgggaatagataagggagagtttgtttgggaggttggatttttatattgatgttgtttgtgtttggtagttttgttttgggttttagaatagatattgattaatatgttttttagggtttttaggtttgggttttggtttttggtagagttttttatttatgggaagaagtattgagtagttttgttggttttttgtagggagttgggatgtatttttaagagtagtatgtgtgaagtttggggtttgggtaaaggagtgtttggggaagagtttgttgttgttggagggttggaagtagaggggaaggaggggtatgtggtaggttgaggaggtggttggtgattttgtggtggggatgagggggttatgagtagattaggagttagtattatgtttttttgtttttagaattgaggatggagagttgttagagaggttttggtggggtgtttggggttatttaaagggtgtgggtggattaaagttgaggaaagttttattttgggggattttgtatttaatttttgaggtttttagagttgtagtttgtggttttttgaagttaattattttttagggttttgtttttgtttttagtgatagttatttattagggagtttttgatttaaggagatttgaaaggttatttggttttttttttatttttaggtaggttatatttagatttttttatatagatttgttttatttttttgttgttttttattagggatggagggtgggtggtttttttatttaggttttggtggttttattttagttaggaaattttttttttttatttgttttatatttttttttttgtggtttttgtttatttttttttaatttgtttttagtggagtagttagtagttggtttagaatttgggggtggggggagtgttagattagtgtagtatatttgagagtgtgttagaggtgtttttatttttatagttgatttagtaaagaaaagaggaagtttagtaatttagtgttattttaaagtttgtttggaatgattttgtggttgttggaattaggggtatgtggtagatgatgggagtaggtatagagaggtttttgttttggattagttgttgttgtttttttggaggttgggttgttttttaagaagaggatttaaggttttgtgagtggtggttttttttggagtttttattgtggttttggttttgttttgtgtaaagagagatggtttgaagtagaagttgttatgtggttgttttaggtaggtgtttgtagttttagttatttgggaggtggaggtaggagaatggtatgaatttgggaggtggagtttgtagtgagtagagatggtattattgtattgtagtttgggtgatagagtaagattttgttttaaaaaaaaaaaaaaaaaaaaggagtagagaaattttttttagaaggtttgtagttattttttttttatgttttagaggtaaaaaaaaaaaaaattgtatattttgttttttttttttttttttgagatggagttttgttttgttgtttaggttggagtgtagtggtgtgattttggtttgttgtaagttttgttttttgggtttatgttatttttttgttttagttttttgagtagttgggattataggtgtttgttattatgtttggttaattttttgtgtttttagtagagatggggttttattgtgttagttaggatggttttgattttttgattttgtgatttgtttgtttttgttttttaaagtgttgggattataggtgtgagttgttgtgtttggttatatgtttttgtttttgaataggtggttttttgattttgggtgtggttattttaagattttgttttggtggggtataattttggttttaggtagggtgattgtataatttattgttttttgggggatatgttagtgaaagggatttttgaatgattatggtgggataatagatgtgagttgggtttgttttaggaaggttggatgtatgggttttttgagttagaggagataatagtagaaagttttgtggttgatgggattgagtaggagaagggttggtggaggttggggtaataatgtatttgtttattgtgaagggtttgtgtgagttgatggttgatgagagggtagtggggtgaggttgttttttgttaggttagattagttttaggatatttatattttttttttagaattggtgatttagtggttagaaggggttttagaattgatgggatattgagggagttgaatggaatggttggagtggttatagtaggttttaggtttttttttgttttttttttgtgttttgtttttggggtttatattttggggttgttgtaatagagtgttataatttgggggtttataaatatagtttttggtggtttttggagatttttggtgttttttggtttgtagatgtattattattatttttgatttttggtttttgtttttatgtggttttttttttttgtttgtgtgtttttttttttttttgttttttataaagatgtttattattggatttagggtttattaaatttagaatgattttattttgagatttttattttaattatatttgtaaagatttgttttttaaatgtgattatgtttgtaggttttaggagttaggatttaagatatattgttttgggggatattgttgaatttattatatttaataaatttagagttggtgttaatgttttttgtggatattatagtagattttggaggttttttgtaaaggaatttgtaggatttttttttttttttggagggatgagattgtagttgggttggggaaagttgttggtttaagttggggttggtttagttggtgttggtttgttaggttgttagagagttttatttagggagaaattaatattataaagttgggggataagagaaggtttggaattttaagggttggttgttgaggttagttgtttatttttttgtgttttattttatagggatttaggtttgttagtgttttgtttttggaaggaatgttgtgggttgttgtgttttataggtagggtggagggtttttttgtagttagtgagttgttttttttgtagtgtgtagagggaaggaggaggtttgtttattttttttggttttagttgaaaatttaattataggttttggtattaggtagatttgtttatttttatattattattgtagagtgagttaggttttttgggtggggttgtgatgagtaggaaggatttttggagtgtttgggattttttgggtttagggttgttagaggtagagagaaagaagtttttttttaatatttgagtaaagatagttattagaatttattagagtggttttttgtggtttttttttgggtgttgatttttttggtgtatttgaagtttttagggatattattgatgttttttgtatttttatttaggggttagtggaaatggttttttttttttttgtttagaggtattgtggatgatgattttaggttttagattttagttattgggttatgtgtgtagataagtttgggtagttagtaatttttggttattaagttggttttttgtggattgggttggtattggaggtgggttttagttgttagtattgtggtttagttaggtttggttttgggaaggtagagggggaggggattgggaaagggattgagttgggggtggggtggtattttggttttttttttttagatttttggtaggtttgaattatttggttgtggttttttaaggagggagtgttttttttgttttgatgtggattttgttttttgtttatgttgtttttgtttttaaataaatgtggttttttgtggggagtttgggggttgttttttattgatattgttgttttttggtttttttttgtaggttttgtttagttttattgtgtttatttttaagtttttttttttggatggttttgttttttgagaatatatttttttttattattttaattgtgtttttttttttatttggagtttgttttatttgttttaggagttattttttttttttattaagtagtttaggttaattttggagggttaatttgtgtttttttagaagtaggttttgagatagggattttagtgggaggggatattaggggatgtttgagtgtgggaatgggttaggtagggaatttagttaataaagggtgttttattagtttattgtgattataggtggttgtttagtttttatattgggtagtatggggagattgtagattgtgtttttagttttgttttatttggggttgggtaagggagttggggtttttatattttagtttttggttaaggattgtattgtttattttttttagttttttgagggtttgggtattaggaaaggttttgggtggagatatggaaataggttatgtgaagttagtgggtgtgattggtagtagtaaggttaggatagttttggttattagtaaggtgattatatattttagtatgtatagtttttatagatatatatttaggagatggtaattatattagtaatagttatttttgttgtgtgttatgtttgtatttagggaattttattttttatttatttatttatttttatttgagatggagttgtgtttttgttgtttaggatagagtgtaatggtataattttggtttattataatttttgttttttgggtttaagttattttgttttagttttttgagtagttgggattataggtatgtattattatgtttgattatttttgtatttttagtagagatggggtttttttattttggttaggttggttttgaatttttgattttaggtgatttatttattttagttttttaaagtgttaggattataggtatgagttattgtgtttggttttaggggtattttattattttattattttttatagtaggtgatattgaggatattgaggtttagagtagattgtggttatgttatttttttgtttggtttttttgtttttagttttgaaataaagagtatggtttttgtgtaggtttatatgttttgtttttagttttggagtagtttttaagttttttgaaggtatattaggtttttgggttttgttttttaagttttggataaataggaggtgaaggagtttttgtaattggattttattttgttagtgttaaggttttgtttgattatttattttattttatatagattagggatttgtgttaaggtttagtgttataggagagtgaagataaggaggtgtttatggtgtatatgttgttggatttattttgtagattttaagggttatggggagttatttgttaggtgaggtttttttgtggtttttttttgtaggtttagggtagtatatagggaggtgtttttttattttttggtattatttgtttggtttttttgagttttgattttggtttttagatagttagtgtttttttagggatagaatttgttttgttgttgtttagaggagatttagtttgattagggttagtgtttttggaatttgagtttggaattttattttgttttgggtagaggttatgttgtttttttttatgagagttgagttgtgtatgagattattttgattttgggttttattatttttttgtatgatatttgttttaggttggagtagggttttgtggtttgtttggtgttttttttttagattgaggtttgatatgtatattaggaagtgtttgatttggttttaggagttgggagtggtttgttaggtagtttgtggttagagtaggggttttaataatggttttttgtgtggtatatttttttttaaataggtttaggtttaggttgtttttgttttgattttgttatgggtttggaggggaaagtttgtatttggagggtggtttattgtggtttttttttgtgtagtagttgagattgtaggtgtttgagaataggagaagttttgtgtttattttgggttgtgagatgtttttttagaggtggggatggggatgggttagtatgtagttatttatattttttagtttgttggtattaaggtttgtgtatgtgtgtgtttttttttttttaattttgtttttttaatatggagttttgttatttgtttaggttggttttggatttttggtttaagtgattttttagttttaggtttttaaagtgttgggattataggtgtgagttattatgtttagttagtattaaggtgtgttttttaagagtaatattggttgggtgtagtggtttatgtttgtaattgtagtattttgggaggttgaggtaggtggattatgaggttagtagattgagattattttggttaatatggtgaaattgtgtttttattaaaaatataaaaaaattagttagatgtggtggttgggtatttgtagttttagttatttgggaggttgaggtaggagaatggtgtgaatttgggaggtggagtttgtggtgagttgagattgtgttattgtattttagtttgggtgatagagtgagattgttttaaaaaaaaaaaaaaaaaagaataatattgatggttttattttttgaatatgttaagtgatttttatgtagtataagtattttagaaggtaggaaaatgtaatgaataatatttattgttatttattttatttagagattgttattttttgtttgggtgtgagtgtgtgtgtgtgtgtaaattgtatatgtgtgtatgaaatggaattaggatttttgtatatattttgtgttttgttatttttatttaatatttttggtattttttatttttaaaaatgtgattttaatgatggtgtaggtttttgatatatgggtttagaaaatttgtggaaatttggattgtttttaggttttgttagtttaatgttgatgtaaatgtttttgtatgtaaatttttttgtatttttgattatttttttgggataaatttttagaagtgggttaaagtatatgaatggtttttaggtttttggagtaagttgagattggtggggattggagaagggatttagggaggtttttgggagtttgtgagattggagtttggttttaggggatttgaatttatagatgaaggagatggttggtaaaggtgggaattttttgttttatgggtgggggggtgatattgttttattttttagtgatagtatggggatttttttaatatgatttggttttgtatttttttgatattgtgtatggtttatagttgtgatgtttagttgggagttttttttgtgttttttagttgtattaattttttgtagatagaggaggaagttgtttggtgtttttttttgttgtgtgggttttttgaatttgtttagttgggtttgtggatttgtgtagttatgtatggggttttaaaatttgtaaaatgataagtttatgaatatttttgtttttgtgggtgaatgtggatattttttggttgtgtttttttttatagggaagatggagatgtgtaaagtgataaggatttgttatttttgggtaggttatgttggttttattgtgaggatggtggtagggggttttttaggaggtttgtatattgggaagagaggggtgattgtgtgtgattgtaggatttagggtgtagttttaggattttgatgggggaggagatgttggggagttttgttttgttagtttggtgatagatattttttaatgttttttggttgggtataatttataatgttttttgtggggaggtaattgtttatgaggtatttttggtagggatgattttgttttattgttatatattttagtaatgaaataagaatttagagtgatgtgatttttttgatgatttttttaattatttggggtttttgtgtgattttaagaagggggaaggaggtagtttttgtttttttgggtttttgatgtggtagttttggaatggttatgtgtttgttggtttatagtgggttatttgttgaatgtggttgtggtgggattggggttgggttggagagtgggtgattatattagttagttttattttgggttattgtgtagttaggggttttatttttttaggggttttgttgtgagtgttttggggttgttggaataaattattggaaattaagtggtttaataaagattgatttgtttatggttttggaggttataagtttgatattaaggtattggtaggattatattttttttgatagtttgaggggaggatttttttttgttttttttagtttgtgttggtttaggtgttttttggttttggtagtatttgtagtttttgtttttattatgtagttttttttattgtgtttttttgtgttttaagtttttttttgttttttttttataaggatattgagtattggatttagagtttattttaaatttaggatagttttattttgggatttttaattatatttgtaaagattttttttttaaataaggttatatttgtgggtttttggggttaggtattagatatgtttttttgggggttattagttaattttttatagaattttagatgaaagtgaatttttataggttgaaatgggggtgaaggtttagtgtgttttttttttttgggagtttttttagggtttgtgtttattttgtgattttgtgatttagttttttttttgagatgaagttttgttttgttgtttaggttggagtattgtggtatgatttgggtttattgtaatttttgttttttgaatttaagtgatttttttgttttagttttttaagtagttgggattataggtgtttatttttatgtttagttaattttttgtgtttttagtagagatagggttttattatgttggttaggttggttttgaatttttgattttaggtgatttgtttgttttgggtttgttttggttttttaaagtgttgggattataggtatgagttattatgtttggtatttagtaggttttggttgttttttttttttgagatagagttttattttgttatttaggttggagtgtagtggtgtgattatggtttattgtagttttgattttttggttttaagtgatttttttattttagttttttgagtagttgggattataggtatatgttattatttttggttaatttttgtattgtttagtggagttggggttttgttatgttgtttaggtttgttttgaatttttgggtttaagtgatttgtttattttggttttttaaagtgttggggttataggtgtgagttattatgtttggtttagtaggttttttagaagtgtttgaggtttggtgaaggtatggtgttatggagtagagaatatttaattttgtttttggggagttggaatatattttttgtagttaattttaatagttatgatgtggttaggatgatatggggagggggtggtgtggattgtgtgggaggttagttttttgggaagggggttggagtgggtttggttttgaggaggatttttaagaggaggaggaggtggtggtatgtttgtttggggggatggtgtgagttagggtgggtatttttttatttaggtgttatttttttgatattttagttgggatatggtttttttggggaagatggatatttttagagtggggtattttttggggaagatggatatttttggaatggggtgttttttgtttttattgtttttttagtatatagttgtatttttttgtagttttggaggttgtgagattttttggttgttatttagaataaatttgtttttgagtagtgttgttttgatggtggggtggtttttgtgggtggaatagtttttgttgttttagagtttattgagagttagtgggtatgggagtggtgttggattgaaatatttagagggattatagagttaggtagtaagtatagaggttagttagtggggagggagggatttatttatgaaaagatattaagtattgaaagagaggagaggatggttggggattggtatatatgtgtattttgtgtagatggttaaggtggtgaggtgttagttatgtagataattggaggaaggaggagtgttttaggggaggggttagttttggttttagaatgatttgtttgtgtatgtgggtttggttggaataaattattgtatttgtattgtagatttaattgtaagtttatattagggtagtttttgttttggtgtagtgtttttgattatgagttggttatggtgggggtgattttaaggggatttttaaggagggggtttattggattttttagggaaggttatttgtttttttgggttggatttgggataaggtttttttttgtttagtttttgttttttaatttgattgtatggaaggatgttgaggatatttggaagttggtttttgttttatagtatttataggatagaggtatattatgtggggatagtttggatagtgtttaggaggtagggagtagattagaggattgtgggaggttttgggaattgtatgaggatttaggtattgagttttgtattttttggtattagtttgatgtatagtttggttttgtgtttattttgtattttattttttttatttgtatgggggtggtaataatattttttatagtttaggtttaagtgggtgtagatgtgatgagtttggtaagtttattttattatatttagttttgggtattgaattttggattttttggttggtagaagtggatatttaatttttttttggggttttggggtttttgtagaattagaatatagttagtagtttgtatgtagggtgtagagggatagagggatattatgttgggagtttatatttggtatatttttgattttggggtttagtgttttgttgttttgtggttatgtgattagttagaggttatggttggatttataggtgaatatagtttgtggatttgattttgtttggttttgtggtgttttattttatttttagttttagtttgtggagatagagttttgttttgttagttaggttgagtgtagtgatatgattttagttttgtaatttttgttttttgggtttaagtgatttttttgttttagttttttgagtagttgggattataggtgagtgttattatgtttagttaattttttatttttagtaaagatggggttttattatattagttaggttgtttagtgttttaaaaagggtttgttttgttttgtgttagtatttaaagattaggagatattatataaagatttagatttttatttttttgagaagtgaatagttttggttatgttgggtttatattttttagggtagtgatggagttgagatagggtttgtgataattgagagttttttggagtttatatggttttttgtttagtttttggtggaggttgagtttagtgatttaggattttgtttgtgtttattaagaaggagaggtgtttgtggtttagagagggtgtttataggagtgttttgtttaggaagttggtagttgaggtggttagggttagggggttgggttttttttttttttttttagtgtttgagtgtatttggaggaagagagatgggtgaggggaaggtattgaaattggttttggagtgttattattgggggttggggattagttgttatttttttttttgtgggtaggggaggtagtggtgggattttatgagatttggattttgtggtttggtgaggtagggagtggttggggagatattgtgggtttttataggggtgtgttgtgggtttggtttggggaaggagttggtgaatgtgtttgttatgtgggtttttttttgttttggttttgataattaggagtggttggtttttatttggagtgtggttgtggggattgtggaggtggtagttttttaggtattatttttattgtttttgagggagtagattttggtggagaggtaggatggttgtagggtgggagttggtggttggtattattgtatgggtttgtagtagtggatgggaagatgtaggagaggttgatgattgagaaagttggtttttgtggattaagttgggggagttggataattaagtggttagaattttgggttttggtattagtttgatgtatagtttggttttgtgtttattttgtgttttattttttttatttgtattgggggtattggtattttttatattttagggttaagtggttgtagatgtgatgagtttggtaggtttggtgttttgttggtattgaaagttttagtgtttgtttttagtgttattgatggggttttgtttttgttgtggttttgattggttatagttgtggttatttattattggaggtatgttttttgttgtggttgatggtagaggtgtgtttgttggtggtgttttagtgtgtgttttggttggaggtgaggagggataaaaatagttgtgataagaaggaaattaaggttgggtatggtggtgtatgtttgtaattttagtattttgggaggttgaggtgggtggattgtttgaggttaggagtttgagattagattgattaatatggtgaaattttatttttattaaaaatataaaaattagttaggtatggtggtttgtgtttataattttagttattggggaggttgaggtaggagaattgtttgaatttgggaggtgttgttgtattttagttagggtaatagagtaagattttattttaaaaaaaaaaagaaggaaataaaagttttttttggaattagaatgtttttatgtagatgtagttggagggggaggttgtgtggtttgtgttgtggttatggtaagatatgatgggtagtatttttttattttagtttgtatttttgttttagaatttatgatggtttttttaggatggggttgttttttttgtttgttgagatatgaaggatgggaagagatttttggtttttattgttgtattgtttgtttttttttgttgttttttagtaggaaatatgttggagtgttttttagttatttatttattaattgtattttttttttttattttttagttttgaaaagattttttgaggttgaggaggttgagatatttaattttattttattttggagggtttagatttttttattttgagttattgtggttagttttatttagaaattttaggatttgggtgtgaagaatttagaatttttggtttgttatgtggattttttaagttaatgtttttttaaggtgtttttgtggagggtggagtttttgggttttaaggtggttgagttggtgttttggtgtattgagttgtttattgatattttgtttaagtaggtggagaatgttggggttattggtttgttttggtttgggtttaagagggttgaggtgttgggttataagatgttagaattggttttttggaggatggagattattattgttaaattttaggagttagtttattggaggatggagttttttgtttttaaggtttttgaggtgtttattgtttttgttattgatgtagtttttaagagggtggagatttagatgtttaagtttgttgaggtgtttattgtttttagtttagtttagattttggagaatttagagtttgtttttgtgttttagttgtagagtaggttggagtttaagttttagttttttgtggttgaggttatattttggagttaggagggtgagttgtagagtgttaggttttggatgttgtggtaatggggggtttggttgttggttttgttatagaattttggaggaagaagttggatatggggtggagggtgttattttggagatttagaaagattggaatgtatgggggtgggggtttgtaagtttaggagaggtggttttttttgtttgatgggaatatgttaagatgttttaagtgggatttgaatgagagtttggaaagattttttgggttttaaggagttttttttatgggttattgtgggttttgttgggatttttgtttgttgtgtgtttttggagggtttgggaggtttagagaatgaggagttatgtaggaattagggtaggtttatgtaggggtgtaggatagggtggagttgagatttttagaagggttgttatattttggtggtttttgtttgaggaattgtaggttgtttggatatgtttagtagaggttgagggtttggggaagggaggagggatgtatgttttttgaggtttgtattggagtttatggtttggttttttttttttaggagggatggttgtggtagagggaggggaatatgaggagtattttagtttgtaggataaaatttttagggtattgggaaggggtgtttggattagggggttgtgtgatagttgtatatggttttatttgggggtgtttttttggtgagaggagagaggttatggggttttagtagtgttttgggagggtttaagtttatagttgtgttgatatggagtttataggtaggggattggtgttagttttgtgggatatagggtttgtttggaaatgttaggttgtgggatatggttgggtttttttttagaagtgtgttttttggttttagtagggattgtggttttatggggttatagtaaggtgttagttgggttagaagttttttaagagttaggtttgattttgggtataggattagaatttagtaatgtttagtaagttttttttaggttggataaatagtatagtttgggtttttgatttagttgttgttttttatttttaattgtggtgaaatatataatatataatgtgtaattttagttattttgtagtgtatgttttagtggtatttagtatatttatggtgttgtgtagttgttattgttgtttatttttggtattttttttatttttttaaattgagttttgtttttgttagattaagttttttatgttttttttttagttgttggtagttattattttattttttgtttttattatgaatttatttgattattttaggaattttgtgtgtgtggaaaaatataataattgtttattttgtgtttggtttattttatttagtatgatgttttaaaggtttatttgttgtgttgtagtatggggtagaatttttttttttttagaggttgaataatattttgttgtgtgatgtatttgtgttgtgtagttgtttttttattggtggatttttgggttgtttttatatttttttaagtttttttttttattttttttgatttttttttgatttttttgagatagggttttgttttgttttttaggttggtgtgtagtggtgtgattattgtttattgtaatttttgttttttgggtttaagtgattttttagttttagttttttaagtatttaggattataggttgtgtgttattatgtttggttaatttttaaattttttttgtagagataggtttttattaggttgtttaggttggttttaaatttttgggtttaaatgagttttttgttttggttttttaaagtgttgggattataggtatgagttatttaatttttttttggtttttttttttgaatgagagttttttagtggttagtgggtttgggggttgggaggatgtggggtttggagagggtgtgggtttggggggagattagtgttttttatgtttttatgggtatgtggagtgtatatttgttttggtgggtttggggtttgggattttgtattttttatagagggggtattggaatatattgagtagttagaggttagtgggttttggaaggttttttttggtttttagtgtgtgagttttgtgtttttttttttatttttttaagtttgattttgaagagttattttgttttagttatttagatttagtgatagtggttgttggtggtatggtgttaggttaaaggtatgggtagtttgtagagtggtaggaggttgtttttttttttgttttttgttggtgtaggatttttgtttgatgtgttggatatatttttattttgggttgatgtgtttatatttagttgagttaaataggatgtggttggggaggtggttgttattgagttatttaaattttggtgatggttggtgttggatgtatagggatgtggttttggttttgggggataggtagggggatgtttatggggatgtataagaatatttttttttaggggtagatatagtttagtttttaaattgtgttagagattgtgttgggagttaggtttagggatataatttgtgggttttgttttttggagtttattgagttgtgagtaggatggttgggatataaggagtgtttagggagtttttttagtagtggaagtataattttattaggttaggaaggggagagaaaggtaggttatgtggaggtagtagtgtttagagttgttaggaatttggtgttttggggggatggtggttttttttatggaataggatgtatatgttggagttggggtatgggagaaaattattagtattttagatttggttatttatggatagggatttgtgtaggtgggagtttagtttatgtggagaggtttgtgggttgggttgatagttttgagggtttaagtaagtttaggtggaggaaatgtagggatagatgagggtagggtttttttaatggaggagtgtttttgaaatttgatgggagtggttttttggggggtttaggtttgagttttattagttttttttttgaggtattatttgtttgtttttttgttttttttttttgtgttatgattgttttggatatggatttagttttttttaatttagttttttgtttattttttttttaggtttatttttttttgtttttttatgtggggttgggttgggagttttttgagttttgatatgtatagttttgattaatttttgtggtttttttgttttttgagtattagggatttagttggtattatggggaaaggaattatggagggagttttgtgttttttgagtagatgtttagttttttggtttttgtttgtgggagggtatttgtgttgtggtttgtttttattttagagttgtgggtgtagggtagggttttttggggttttagttgaattgtttttagattgatttttttaaagtatagtattgttgagatttttttttgtgttgagttttttttgtttatttattataggtttttttatggttgatttatttttttgtttagtttatattttttttttttttagttttttttgttttggtttttttttggttttttatatttttttttataatttttttgttttgattttttgaattttgatttttgtttttttttatattattgttttggtgaatttttatgtattttttaaaatttggtttaaatattttgtgtttggtttgggatataaatgatttgtgtataaatttttttttttttgttagatttttttttttaaatgtgaaagtagttttttagattataaaaagtaattgagtattttttttttaaaatgtaggaagtatagaaatgagaaagaatttaaaatttatttgtaagttagtgatatttatgtttgaggttttgttgtatagtttttaaaattttttttatgtttttattagattttgagggtagggttgttgtttttgtttttttttgtgttttttttttgttttttgttttttgagatggagtttttttttattatttaggttggagtgtagtggtatgattttagtttattgtaatttttgttttttaggtttaagtgatttttttgttttagttttttgagtagttgggattataggtgtgggttattatgtttggttaatttttgtatttttagtagagatggggttttattatataggttaggttggttttgaatttttgattttgtgatttatttattttagtttttttgattttttaaagtgttgggattatgttattgtgtttagtttgttttggtttttataaagaattttataaggggttaggtgtagtggtttatgtttgtaaatttagtattttggaggttgaagtaggtagattgtttgagtttaggagtttgggattagtttgggtaatatagagaaattttatttttataaaaaatataaaaaattagttaggtatgatagtatgtgtttgtagttttagttattggggaggttgaggtgggaggattatttaagtatgggaggttgaggttgtggtgagttgagattgtgttattgtattttagtttaggagatagagtgagattttgttttaaaaaaaaaaaaaaaaaaaaaaaaaattttataagatattaagtaagtgatttggatataataggtgtgttatgaaattatgttgaaggagtgagttattggtggtgagttgggatggtttttttgtggtttttgtaggtagatgtagtgatttttatgggttgtttttagagattaagtagaaatttttttggttaattttatttttaggatatttggttttttttttggaggttgtgttggagggtttagtgggtgggtgttggttttagtgtgggggttttggaaggagttagtattttaggagggagtgtgggtatttagatggttgaaggggagggagaggaagagaggtgttgtagagggtagaggtatttttgtttgtttttttgttttagggtttggtgaggtttgagttttatgttggtggggtggatttttggtttttgaggttttggttttgtttttggatttggtattttttttgttgtttttttatagaagggtgtttattttttggggttatttttggtttttttaggttttgggtggggatggttttgtttttttttttggatttttgttttttttttgttttttaatatgggtgtttttgggtggagtggggtggggttgggttgtagtatttagtattgagtttgtaagggttggttgttggtttagagttttttttattagagttatttttttttggttttttagttatattagttaagtttttttagagttgttttataaggtgggtgtttagtgtttgtttatgggtttggttttttgtttttttgggatgtttattgggggtaagagggaggttaggtttagtgtttagtttagttttgggtatgttttagttttgttttatgagttaattggttttgaattattattttattttttttagttttaattttttgatttgttaaagaggtatttgtagaggtggttgggggttgagtttttatgtatttatttattttaagaattaagaagggagtttatagtggttttggggttatttgtgaatatggatgtgaaattggggtggggtagatatggtagtatgttttagtagtttttttgtgatttagagggtttggaaatttttgttatgtgggtggagtgttgagggagtagggggttaggtttttttgagttgatgatggtgggtgtggttttttgtatatttggtttgtattgggttgtgtgttttaggggtagaatagggaggaattttagtatagatagtagggttgttagtatagtgttgagtatagggttaattaaagtatagggttttttggaattatttaatatagagtagtgaagaggtggttttggggaaagtggggttagagttgagtttgagtggggggtggggagggtgggtattagtttgtaagggagggatatttattgggttttagaagtttttggtggggattagggattgtgaagttggggagagggtgattattgtgatttagggaggaagggttttatagatagtttagtttttggttttgtgtttataggatattttatataggttttgagtttatttttggattgtggattttttgaggtagggtgtgtaggtttgtttagtattaggtgtaaggtagggggttttggtaagtgttgagggatttattggtgtttgatgaagtagtgagtttggattgtgttatgttttgggttttgagtttgtaggatttttttgtggggttgtgtgtttttgtttttggaggtgtttagaaggtattgatgtttttgttgggatgttttatttggaaggttttgttgtttttatttttttttatttttttgagttgtttgtagagggtatttaggtttttttttattttgggattgggtttttttttttttttttttttaagaataagtattttttttttttgaattgtttttggagttttttagatttaggtttagagtgggaagttttgtatgtgttgggggaataggaattaatgtgggaggattggttaggtttggtgtgttttttttgtggtgggatggggtggggttagagaatagagtttggttttagagtttaggaagagaatttttttttttgttggtttgttaagtattgtgtagtggtgagaggaaaggagggttggtttgggaatgtagtgggtgttgagtagttgtggaatattttaaatagagtgtagttgtggggaagggtggggttaggaggtaggtgttgggggtggtttttttgttttgttttttgtagttttgtggttttgattatttagtttggttttaggatggagttttggtttttagatatatggtattgggtgaggttgttttttagtatttgttttaggaagttagagtagttgttagaagagagaggagttgtgtttgtatttgttgttttttaggtttgggatagttgttgggattgagggtttgtataatggtgagtttgtttggaggggtgtgttgtggttagatagttatgttttgtgtggtgtggatagagggtatatttagttttggaggagtgtatttagattttttgttttggggtttaaagtgtgggtagtttttaattagattttggattttagtagatagtttgggaggatgttatgtggtttattttgatatattgttttatttgtgattttatttttgagagttgtagggaggtgtttttttagttggattttattttttttttggggttttttgtgggtgttataagtgattttgttttttttagtttaaggggggtttttggggtatgggttgtaattgataggttagagtagtttatggttagggttgagttttttttttgttttttttgaatattgggtttaggaaggggttaaagtggagatgttttgattaaagttgagggaggtatggagtttttttgattttgtttttttattttattgttgttattgggtgtattttgtggagttttaggatttttaaagaatttagagtggagatttttggttttatttagtgtaggtgagggggaaagtgatttgtttatagttatatggttattattagtatatttgggttaagtttgattttattttatggtttttgtttgaaatttggaattggaaatggttttggaaattattgattttatttgttgttttttaaaatggtttgtagaggttaagatatagatttttgtaatgttttgtttatttgtgtgtggggaaatggtagaggagtattggttttgtttttatattgtttgggttgttgtttttgttttgtttagtggtttttttttttggtttgtttttttattgtggaagtgggtataattttttttgtgtagtgtggttagagtggatagtgatgatttgtgaagtagggtggagtgtttgggggatttgtgttaaataagtatataaataaaagttaatataatttttatttaattagtaagtaggttttgtttgaagtttttgggtagtattttatgttatttttaggttttaggttggtggtgttgttttgtgttttttttatttgtaagttggtgtttagaagttttgttttgtgttttggtttttattttttttgtgatttttttttttttttattttaaaaagtaatgtatgatggggtgtggtggtgggtatttgtagttttagttgtttgggaggttgaggtaggagaattatttgaatttaggaggtggaggttgtagtgagttgagattgtgttagtgtagtttagtttgggtaatagaataagatttttatttgggaaaaaaaaaaaaaagtgatgtttagttatttttagatagaaaatgaagattatatgaaatttggaaagaagttttttttttttattttttaatttttttttaaggggtggttatgttgatagttgggtgtggtatttttttgaattttatttttgtagagttatttagggtttgtgtaaaaaaagttaatgtgtaaatatagattttttaagaatataaaggaaattagatttttgttattagtttttattttttttatttaataatattgttgttatttgtagatgtagtatgtttttttttttttttttttttttttttttttgatagagtgtggtttaggttggagtgtagtggtgtgattttagtttattgtggtttattgtaatttttattttttgttttttgtttttaagtgatttttttgttttagttttttaagtagttgaaattataggtgtttgttattatatttggttaatttttgtatttttagtagagatggggttttattatgttggttaggttgtttttgaatttttgattttgagatttgtttattttggttttttaaagtagtatgttttttttaatggttgtgttattagttgttttatggttttgttaggtttgtttagttttttattgtgattgagaggttgtaatagatgtttttgtatttgtatatgtgtatatatgattgaaggatgagtttttagtgaatttttgtgttaaggatgtgtgtatttaagttttgatttgttgggtatagtggtttatatttgtaattttagtattttgggaggttaaggtgggttgattatttgaggttaggagtttaagattagtttggttaatatggtgaaattttatttttattaaaaatataaaaattagttgggtatggtggtttgtgtttgtagttttagttatttaggaggttaaggtaggagatttgtttgaatttagtaggtagaggttgtagtgagttaagattgtgttattgtattttagtttgggtgatagagtgagattttttattaaaaaaaaaaaaaaaaaaaaaaaattgatttttgtttttgaattggtttttaaagtggttattagaattttttaggatttttttttttgttgatttgtttagttgtttgttgggttttgtgtagtgatggtttagtagggaggttttatgttttttatttttggttgagggttaaatgttttttaattggtgttttattttgtgtattttggttaagtgagagggattatttttttgtatgttataggttagggttttgtgttttttttttatttggaaggtgtattttttttttgttgaaattttttaaaaagagttttttgtaagttaggtgtgatggttaatatttataattttagtattttgggaggttgaagtgggtggattgtttgagtttaggagtttgagattagtttaggtaatatggtaaaattgtatttttgtaaaaattagttgggtgaggtggtgtgtttgtagttttggttatttgggaggttgatgtgggaggattatttgagtttgggagtttgaggttgttgtgagttgtggttatattattgtattttagtttgggtgatagagtgagattttgtttaaaaaaaaaaaagagttatttgtatatttttattatagtaggtatgagtattttgtttttagttgtttatttttgattttgtttttgggatgtttttttatatagaatattttaattttgatattgttaagtttttgtttttttttttagtttttggaatttatattttgtttagaggttttttgtgttttgaaattataggaaagaattttatttatgtttttttttagtatttttgtggttttatttttatatgttgaaattatgaatttattggaatgtattttggttttagtagtgaggtaggggtagatggtattgtttggatatatagtagtgagtttggtttggagtgggtggggtgtgtgtgtgtgtgtgtgtgtgtgtgtgtgtgtgtgttatttttattagttttggtgtttgtattgtgttggtttagtaaaaataatttggatgtattttttttattttttgttttttggaatattttaagtagtaatataataatttttttgttaaaattttttaagaatttatttgtgaaattatttgagtttgatatttttgggggagtttagtattttaaaaatttaaattttttttatgggtttgtgagtttgggagtttttttttttttttaaaatttattattattttttttttagaaaagtgttttttagtttatttaaaatttgttagtttattttgagggggttgttttagtttgtttagtgaggatagtgtgtagtgtggtgattgatatgattgattagtagagtatgattgattagttggtgtgtaaatatgattgattgtggttagtgttttgggatgttttatgttgaggtatatgtgtgtagtgtagggtgatgtgtattttgagaggggatgaagttataggatttttgtatttttaggagagagtttttttttttaaggttgtagttttgagtaggtagtgatgggattgggtttagggggttgagtggttttagtaggttaagggttttaggaattatgagaagtttggagttgtttagagagtagtttttaaaattagtttggattgtagtttttagaaagatatgtgattgatattatgaattaggatatatttatatatggggtgggggtggggatgggatgtattaatgaaattaaatttttgtgatggaatttttatttttattatgtgtgtgttatatttagtatttttttttttttttttttttttttttttttttttttttttttttgtttgtttgttttggagagagggaaggtttttttttatttttttttaaatagttttattgagatttaagtaagttattatataatttattaatttatttatttatttatttttttgagatggagttttatttttgttgtttaggttggagtgtagtggtgttattttggttgattgtaatttttgttttttgggtttaattaatttttttgttttagttttttgagtagttgagattatagatatgtattattatgtttggttaattttgtatttttagtagagatggggtttttttatgttgaggttggttttgaatttttgattttaggtgatttatttgttttagttttttaaagtgttgggattataggtatgagttattgtgtggtttaatttatttatttaaagtgtataattttatggtttttagtttatttagagagtagtgtaattattgttattataattaattttagaaaattgaaaatttgagaaatttagaaaattttttttttaagaagaaattttgtagtttttagttattaattttgttttttttttttatattttttttttatttgtgtggattttttttttttttttttttttttttgagatagggttttattttgttatttaggttggggtgtaatggtttaatttttgtttattgtaatttttattttttaggtttaagttatttttttattatggttttttgagtagttgagattataggtttgtgttattatgtttggttaatttttgtattttttgtagagatggggttttattatgttgtttaggttggttttgaatttttgggtttaaatgatttttttgttttggttttttaaagttttggaattataggtgtgagttattgtgtttggttgattttagatattttttgtatagagaattgtatgtttggtttttgtgtttggtttttttatttggtgttatgtttttaaggtttatttatattgtggtaggtgttagtgtgtttttgagtaatattttattatggtatggattattttattgtggatagatatgttgtttttattagttgagggatattgggttgttgttattgttggtgagtgtattttttttaaattaaaaaaaaaatgttggttattatttattagattgtttttttggtttatagggtgggataagttggtttgggtgagggttaggaggtggttaggtggaggtggttggagtggttttgggttgtttttgggtgtagtaggtagaggtgtaatggtagagtttgagtaggttttttgggtggatttttatgttggtaatgtttgtttatttaagaagttttggttaggtgtggtgttttatatttgtaattttagtattttgggaagttgaggtaggtagattatttgaggttaggagtttgagattagtttggttaatatggtaaaattttgtttttattaaaaatataaaaattagttgggtgtggtggtgtgtatttgtagttttagttatttggtaggttgaggtaggagaatttgtttgattttaggaggtagagtttgaatttaggaggtggaggttgtagtgagttaaaattgtgttattgtattttagtttgggtgatagagtgagattatgttttaaaaaaaaaaaaaaaaagaaaaaaaaagaaatttttagtgttgttttgtgtttggtattgaagttgagggaaggtagtattagtatgagtttttagtttattgggtttttgtttggagttgatgtgtgattaaggtatatgagggaagtatggtgaggtggatggtgtggaggtataaggagtaaaataaggtagatgtagtggtttagtggtttttggtggttgtgaggagtgtgggtaggatagttttaggagggtatttggagagtagggttggttggggtaaggtgtgttaggtatttgttaggagtaaaatgtaaggggatattaaagagtttaggaattaatatagatagtatttaatgtagtattttttaatattgaaatgatgtatagtaatttttatgatgaataaatgttggaattttaaattaagataggtttagttttgtatgtgtatagttttgttagagtttgtttagtgtggaatttgatttgtttaaaatgttgttttaaaatattgtttgatttttggattttttggtattgttttaatttttgtatttggatgaaggttttattttaattttagttggagagggttaagggttggtgaatttggttttggatttgtagagtttgtggtatttgagaggtggggttaggaataggaaggagttggtgagaatggtatttggtatgggatggggttagattagagtagtattgtggttttttttaatttgtggttttgttgttggatgtttggtgttggtgttgagtttttggttttttgaatggagtgtgatgaataatggggttggggagtttttgggtttttttttgaagtagtagtgaagttagggatatgttggtagtaggtagggagagggatgtttggtttgtgtttggagttagttgttttatggaggagttgggtgaggatgtggtgggaggaagatttttttagttttgtattttttgaagtataattgagtgtttgtgtggtttgggggttattttggtttgaggatagttttgttttgtttagttaggttttgaagagttattgggatatggatagtagttttgttgggtggtaggttgtttatttttgtttatttaatgttggaattggatgtagagtatttggatggttagttttagagtgtttttgatatttttagttattttattttttagattaggataagatgtgggattttaattttgagttttttatgggttttattttatgtgtttttataagttattgggtttattttttggttttagggttgtttggttatttggtattttggtttttttatttgtataatgaaaataatagttttagtttttttgaggagttataagatgttttttgtgtgaaaaattgggatttggtattagattatttggatttgaattttggttttattttttttaatttgtggttttgggttaatttggtttttttgtttttagtttttttatttatagagttattttattgagttgttgggaggatgaatataaggaagtgtatttatgtgtttagagtattgtgattttatttattattattaaatgaggtatataataagtgtttaatagatgtttagtgttattttatggattttgtgtgttttgtgtgtttttagtagttaagttttggaggtggggaagttgttgatgagttgtatgaggtaattagaaagaggaggttataggtgtaagggtttgggtgatatttgtggatagagagaggttgatggattttggtagaggggaagggggtttttgtatatagaaaatgttttttgtatttaagatttttgtgattttggaatagaggtagtagaggtttgtaaattttaaattataaatttagaaagtatagaatatttgtagagaggattagaaatattatatattttagtgtgtatagaattttttatatagttaaataaaagtatgtttttaattgaagttgttggagagtttttgaggattttatattagataagggttggtaagtggaagtttaatatgtaggagttattttttttgtttataaatgtttgttgttttttttgtttatatttgtatttatgtgagggtatttataggtttattgtttagttttatgttttgtttgttattaaaaaattttttaagaattttttagttgtaaatttttttattggagggggggttttaggaatttagttttgtttggggttggggtattttagtatttgttgtataggtgttggttattaaaggttatgtgttgtatttgtgggtttttggggtttggtggtatttgggtatatagtttagtggtggttttttatttgttagatattgggagtggggggttttttatttttgttttttggtggtggggggagtgttttgagttgttatatattagaatttattgatttatatgttgtggtattttatagttttttgatagttttttagtttgagagattattaaattgagtttttggagagggtggttgttgaggtttggatataggtgtggataggatagttttgttttattttggagttttgttttggtttagttttttgtgggtttgaagtttaggttgggttagtttttgttttttagatggttggaaaggtagtttagttttatggtttttttgttaggttttgagagttgtttggtttttagttttgtttttttttttttttaagatggagttttattttgttgtttaggttggagtgtagtggtgttattttggtttattgtaatttttattttttgggtttaagtaatttttttgttttagttttttgagtagttgggattataggtgtgtgttattatggtaggttagtttttgtatttttagtagggattggtttttattatgttggttaggttggttttgaatttttgattttaagtgatttgtttattttggttttttaaagtgttgggattataggtgtgagttgttatgtttagtttttagttttgttttgatttttttttaaggttgtgaggatgtttatgtttttttttttttttatggtttattgatgtttttagatgttttgtaaagttattttttttttgggagttttttagttggtgatgggggattttttggggattattgtttaggtagttatgtaggtttgtgggttgtgtttttaggttggattgagatttggtgtatggggtgtttttggtttgagttgaggtttttggaagttatagttaggaggtagtaagggatggttgttatgtttttttttttttgttttttagggtttttgtgggatagatttttttgtttgagttttttggttgtttatattttggttttttaaagtttagtttgaagttttaggtattttataatttgttttttttagtagtttgttttgttttttttttgttgatgtttttgaaatttttttgtttttttttattttttggttagagagagattggagattttgtgggaatttttgaggggagggagaaggttgttgtttgaatggaggtggtttttttttttgtttttttttaggtgggttatatttgtaggtttagttttttgttgtggtagtgtttggggtgttggttgttttttgggtatgagttgggagttgagggaggtgtttttaggattggagtggtaatttagttggaggaggagtaataggtttgtggttagtagtagttgttgtagggattttggtgttgtatttgtgttttagttgattttttttgtttttttagggtgggttggggatggtggtttgttgtttagtttaggaagaagaggggttgtaattagtagtagttattttaggggattttagtgttgtatttgtgatttagttgattttttttttttttttagggttggttgggaatggtggtttgttgtttagtttaggaggaagaggggttgtggtttttattttagaggttttttttttggttttttttttggtgttggtttaattgtaggtttgttttaggttgtgttggtatttgttgattgatgtttagtggatgttgataggagagggttgggatggggaagtagtaagttttggttattgtgggtttgggttatagatggttgaggtattttttggttatttttaggaagtaaggttttatgtagtttttgatttatttattgtttgtgtgtattttaggaggttgtattttttaaggtttttattaggtaattttattgggttgggtgttgttgtaaaattatttattgggtgtggtggttttttggtggggggtatggttggggaggatgtggtggaggagaagttagttttgtggttggggggagggtggattatttgttttttgtttgttttttgaattggagtttatggttttttttttaggtgtttgggttatggaagaggttatagttttgttttatttttgtggtagtttaggggagttttggttagttttgtgttttttgggagggtgatagtttggttaggttgtagggtaggattggaatgtagatttttgtttggttatgttgttgtttggttgttttgtttggggattttttgtttaggaagagagaagtgggttggatagtttggtttagtgattggaagtttagttttttatgtttagtttagtaggaagtttgtttttttggaatatttgtgtgtttttgtatgtgtttttttggttggtggttttgtgaggtttttattgggttgtgttatgttttttggttattttggttttggtgtttggtttttgtgaaatagagatatttgggtagttttttatttgtgtttgtaagtttgtgtggttttagtgatggttgattttgttttatttagaggatttgggaatttttagtttaattgtttagaggagttttttttagtggggagagtttgagttgtttttttggtggatagttttttagattttaggtggatttttttgttggttgttttttttgttgtttttgtttttttgttttttatttgttttttatttttttttttgtagtagttagttggtatggggatttttttttttttttgggattgtgaatgagatgatttttttggtttttttgggtttagatttttttggtaatagttagtgaaatttttgttttaggtgggaggagaaggtttagtatgtggttataataatggttttaattatattatttttaaatgttggtttttatttattttttgttttgtttaatagttatttttattattttattttttagattaggaaattaaggtgtagagagttttagttatttgtttgaggtttttatagttaagtgtttggatttgaattttggagtagtttggttgttgagttgttttggagatggggtattgtgtagtggttggggtaggggtggagttttgttgttgttgatttttgggttatttggagtgataatatagtttagtgtttgggtttttgtttgagattttggttggatgttaggagtttgagattttttagtttttttttgtgtaaggtgttatggggtgaaatgaaagaaaattttagttagaaggtgtttttttttttttttagttttttagttgttttggattttgaaataagatattgtttgtttgtggggtgagtaggaatagattggaattgtatttttttttttttagttatagttgttaggagtttatttttttttgttttttttttttgttgtttttttttataagattgggttggatgttgttgggaaagttaataggaagttttttggttgtggtggaggtgggggtttgtgtttttttggggattgagatgagggttttaggttggttttggtaagagtagggaggtttatgtttttgtttgttggttttgttttttgttttgggagaaggtatttatatgttttagaatgtattttttgtgtgtatagggatggtttttgggttatttatttgaggtttattgatttttttttttggaattggagtggtttttttatggtggattgggttgagttttttgttttggttgatgtttttttttaggtatttttttttattgtgttagggtgtaggttgttagtggatgggtttttatttttggggattggtagttgttatgtttattttatagttgagatattttggttgaaggttttgttaagttttatggagtgtagggattttttttgagatggtttttttttgttgtttaggttggagtttaatggtttaatgttttgtttattgtgattttgattttttaggtttagtagtttttttattttagtttattaagtagttgggattataggtgtgtgttattatgtttggttaattttttaattttaatttttttttgtagaaatggagttttattatattttttaggttgaattttaatttttgggtttaaatgatttttttgttttggtttgttaaagtgttgggattttaggtatgagttattgtgtttagttggggtttttttttaattttttttggttttttttaggtgtaggatttgggttttagttttatgtgtttttgaatagttttgggttttgttttgtattttttgggtgtgtggttaggttttttgtgatattagtaggagatttaggtgaagaagtaggtagaatggaatgtttgtttatttagttttggggttaggtggggtggttaggatagtagtagtggttggtgtggttttttgggaggttagtttattggtgtggttagtgaatggggaggggagtttttttttttgtttttttttatttttggtttttgggtttttagggttaggtttttagagttttaggtggaggatggaggttagggaagttggggtaagagtgggttgggggtgggtggttaggtggattttggaaaattattttttgtaggttttgttttttttagggagtatttagggttggttttggggagttgggttaatggttattttggatggtgtaggggtttatttttatgaaattgggtttatttttatgaaattgggtttatagaagtttttggttttggttttgttttgttttttggtttttgtttttaaagtaggatttaggatagttttgaattttttgttgaaatgtagttttttgggttttaatttagttttttagaattagagtttttggggtgggttttttgtttgtttagtagtttttaggggatatttgtgtttgttagagtaagtttaataagtattgttgtaaattttttgtttttatagttttttggtttgtttttttttttttgttgggatttgtattaggattaaatgttaatattagggattaggttatatttgtgaattttgagataatatttgtattttttttttttttgaggttgttttgtttgttttgttatttaggttgaagtataatggtgtgatatttatttatggtaatttttatttttagggtttaagtaatttttttgttttagttttttgagtagttgggattataggtttatattattatatttggttaatttttgtatttttagtagagatggagttttattatgttggttaggttggttttgaatttttggttttaagtgatttgtttgttttagttttttaaagtgttgggattataggtgtgagttattgtgtttggtttgatatttatattttgattaagttgttgtggaaatattgagttttttttgatagttttgtttatagagtgaatgtttaggaattggtgaggtattttttatttttatttagatggtggtttggaggtagtgtttttgattttgtgatgggatttgttttttttgtttaagagattttagagatgtggtttttgaatgtgggggtttttgttggggtgggaatgggagttggttttggttattgtttagtgattttattttagtgttttgattttagtatttttgattttagtgtttttttttttttggttttgtgtggagattatgtggtttgtgttgagtaattttttattgtttttgttgtgtttttgttgtagggaagtttttttagggagttagttgatatatttggtttttattatttgtttttgaataggaatgaaaggagagagtgagtaagaaagtggtaggaggtgggggttgtagagtaggggaaggttagagagaggggaggaaagatttggaaagtttaggtatgtgttttggaagtaggtgttagtgatgagtttatttggagggtggttgtttgttttgagttttgtttggggttagtagggaatattttgttagggtatgttgttgggagtttgtttttggtttattttttgttgttttgagtgttgagtagatttgtttttattttagggataatgtaaggaggttgttattttattttttattttattaatattttatgaattataagtgattatttattgtgttttgatgtattttaggtgttgggtttgaagttttatgtgttttatgggatgtatttgtattattgttgtagaaaatggtttttgttattattgtagagaaggtattgaggtatagagaggttgaggaattggttttaggttatatagttagaagtggttgattttggttgtgaatatagggttgtttgattttaaagtttgagttggtttgtagtgaggtttatggtttttgtgttattgtttgagtttttggttgagttttttggtttagtggggggtttagtgatttattagttgttttattatatgttgtggatatttttatggtttatttgggtgggagggaaggggttttaggaggtgggaggggtatagggaatatagtttagtttgtttgggtttaatattttgatttttaaggtattttttgagggtagtatgaggttaagtttttgtttttttttaggattttgtttttgtgagggttttggggttttttgtttttttttgggggttttgttggttaggattatagagaagttttttgttgttgatttttttgtttttgtattttttggtaagttattttatgatttagttgttttgtttgtaaaatgggttgaataatattgttttgttttggagggtttttgggaggattaaatgagatttgttgtatagaagttttttgtaagttatgttgattggtggttgttgggtttttaagtgaatgggtatttgggtattgagtgtgtggatttagtatttggaaggaggggttggggggtatttagaatttttgggaggtttggatttttgttttgtttagattttgagtttttttttggttagtttaatttttattagtagggtgagggtaattaggatttatgtatagttgggtgaagttgagtgattatatgtggaagtttagtgttttttatgtaaagtgggtaggtggttaaagtgagttttgttttagtttttttatttttggggttgtttttggtgttttgtttttttttagagttttattgatttgtattatgtgatttgggtttgggaagatgggtttagttgtgggaggttgtgtgggttggggattgagagtgttggaggagggttttttaggaaaatttagttgtataggaagttgggttagtggtttttggaagtttttgggttttgtaagttggattttttagatttgtggttgtggggtttttttttgtttgtagttgagagtttttgatttgtatttgagggttttagaggtttgggagggggatgtgattgtgtttttagggtgaagtttatttgagtgttattttggatatagtttttatttttttttggttttttttttggttatggggatgttgtttggggggggtttttttatatggaaggagttgtagttgagttggtgggttttgtatatttttaaggttgtttgatttttagtttttaagtggggttgtatttattatttaggatttggagttttagttagagagggattttttattgtttttttttttgttttttgggaaaggtagggtttttgtgtttttttttatttagggatttggtatgttgggaggttaagaggaagttgttttttgtttatttattttttaatttttttagttagtagagttttatttgtgtgtttagaatttgtgtgtggagttagaagttataaggttggtttagttgtgtttgattttggttgtgtggttttggatagttttagtttttttggagttgagtattttgatttgtagaggagaggttgttgtgttggttttgtagggttttgtgtagaggggagtgtgtgtggttgtgagtttaggttatgtttttagattggaggataggattggaatagtgggttaggatggttagagggttttagttttaggaggaggtttttatattttttagtatttttatattaggaaatgtagttaggtttttaggttttttatgttaggaagtagtattttgttttttatttttggttgtttgggtttgagaagttgagtattttttttgaatttgagtgttttttgatttttgtttgggtagttgttttttttgaattgattgtttgttttatatagttttttgtggtttgtttgatagggtggttagtgagttttttgtatagtatattttttttaggagtgttgtttgtgatgatggtgtaaagggtgtttttttgagtttttggaggtatgtagtggtgtaatagtgtgagtttaggagttttggtgagtttttggatggagaatttgtttagattattttttagtttaaattttttttgggtgtttgttgtgtttggggtgttgatttattgtggggtggtttgtgagattttatgttatttggttattttttttagtttttgtttattgtattggttttttggtttggttgtttttggaatatgagggtttatttttatggaagaatatttatttgtttttttttggaaagtttttttttagattttttggttgttttatttaggttttgttgaagtgttgttattttggagaggtttttttgttatttgtagttaaaatagtttttttatgtttgtgggtggttttttatggggtatggatgagtattggagagttttgttgtttatttgtttatatgttttttgggagggtaggggatattgatttgtgttgtgggtgttttgtatgttatgggtgtttagtgaatgtttgttaagtattaggggagtataaaggagggaagtttttgtttaattggagtagttagggaagattttttggaggaagtggtatttggtttgtttagaatgtggtgatttgtttgtatgtagatattagattagagggtaaaggttattattataatttagtagatagttataagtagttaaggaattgttatgatatggattgtttgtgattggagttaagaaggagttagagatagaggtttttgtgttttggtgtgagtttttgggggaggttgagtttttagaatgtggggttgtttgtgtagaggttggaggtgggagatatatttgtgagtgttggtgagtgtggggtgagttattggggttggattagaagatgggaatttttaaatttattaattagttttggtgttttgggagtgataggagatggggtttttgggggattaatttagtataagtggatgagatgggatgtaggggaaaggataaagttttttgaggttttgggaagttgagttagggtagagttatgatagggtgagttttagaagtaatataagaaaaaatagttagattgggttttttttttattgtgggagatgttttattttattttttttgttttttgggttttggtaatgggttgggtatagtgaatgggttttatttgtaggagtggttatattttttgggtatagttgttttatatattgtattgagatgggatttgaggttgggaagaatagttttttttgtaggttgatattgttagtttttggggagggaaggatggtagggggtttggagtatttttttttgttatttatattttgtgtttgtttgtagggttttgagttttgtttgttttgttttagttttggttaggaatttgttggagtttataggggtagttaggttggaataggaggagattaggttggtaggggagttgagagggggttttggatagtatttagggttgagttattttgggtttgtttgatttgttatttggagttgtttttgtttgtttattatgtgtaaggttttgatttatttgggtttgtttaattagtgtttttttttaggtttagttagtttggtttttgtttgatttatttattgttattagtgttatttttgtattatgtaattagtttttgtagtatgttagttattaagtttagggttttttgtgtattttttgtaatttttatagtaatttgggaggtatagagaggttgagttgttggtttatagttatatagtaggtatggggtattgttaggatttagttggatttttgattttagggtttttttagggttttgggtgggatattggtaaggaagtaaggtatgaatattggttttgttttggatagagtttggggatggtggtttggtaggtttagttgatatagtgattttggtgtaggtttaattattggtaaagtgtttaagtatatatagaattttaattggggagataggtgaagtggttaagggagggttgtgagtgataggtggatattgtatttattggtagattagttgattttggtgttttttggagttttttaatttttttatttagaaaaagaggaattaatagttttatttttaaattgggtgggagtattatatttgaaattgaagtaaagttggttgtgttataggtttggtagatgttagttgtgtaggtaatttagtgattatttgaagtaggttgtgtggtggtatttttattttgtagatgtagtttagagaggttagggtattaattttgggttatatagtgatagtttaggttatagagagtagtgttggatgggagggtgttggtagttttaggtataggttgggagggttgtggggttagtagagggagggtatattttttagttggtggggtttttttgtgttttagtatttatgtgggtttaaaggagttggaaggagggaggttagagttatttatgggtttagaagttgataagtaggttattgattttgaatttgttttattgtatgtaaattggggataaatttggggatttaatgatataatgtaagaagtagatatgttatagttttggttatatagttagtgtataataagtggtaagttgttagaggaggtagttggtgagaatgggagtattttagtagttttttgttttttgtttttggttgtagatgtatttgtttttggttatttgtgttttagttttgtgttttttggtgtgtgtgaggttaagtttttggggtggggatttgggggtgtgtttgtagtttttgaggttaagattaaggttgaggttgaggttgaggttgaggttattttggtgaggaggaaattgtaggtggagaagtttgttgattgtgattttgatttgattgtaattttgatggtgttgatgttgttagtatgtaggttttttgtttttgttatgattggtttttgtagtttatttggttgagaggtgtgttggtttttgtaggttgtaaaatggggatattattgtttgtttgggttatagtgtgtttgttgattgtatttggggagggattgagggttgattgtgttgtggggatgttggtagagaattagagagggtatttaaaaaggttaatagtttggtggggagaggaggtgtaaggttggtttttgttttttgggttttgattgaaagggaataggggatatatttggggatagttttttttttggaggaagaagggtttagggtgttggtgtggagtttgtatagatggggataatgagttggagggtgttgggtaggagttggttagtaataggttgatgagggaggttttgttggttgggtttggtttttaagtgagtattttgagttgtggggatttagggggttttagagattttagagttgagatttgggattatagaggggtgggttgtgtttagggtaatatagtggatggggtagatgttgtgaaatttgtttttttgttttttttttttttgttatagaattggatttttttagtttatggttgttaaattttttagatgtttttgggttttatgggtgttttatattggtttttttgtaggatagtagattttgggggttggttttgatggtatttattatggggtattttatgtaagtatagtgtttttatgtttagttttttagtttgtggagtaggtttgtgtttggttagttttattttgtggttagaggagggagatagtggttttggagataggagttggtttggggttgtttttttagtttttgtttttttagtttatttttttgttttgtgggtgttggttattttttttttgttagttttatttttagttttttttgtttgagttgtgatttgttagtagggggtagtggaggttttgaaagtttttggagaggattttgaagtagtttttataaatttgtttttggaaagttttttttgttatatttttagtggtttttttttttttaatattttttttggggttgttatgtagtggggggtggaggaatttattaggttgtggatagagtagagttatgttgatataaattttggttgaatttatatgttttttatagttagtggttgattattggaattagggaagtgattttatagtaagggtttgtagagtagttattatgtatttttgattttggtttttggatttagttttggaaaagaagttagattttagttatttggagttgtttagggaagattttagtttggtgttggttgatagtttattggaattttttatttgtttggttaggtgatgttaaggggtagaggttagaagtgttaagaagtaggttgagggtggtggtttatgtatgtaattttaatattttgggaggttaaggtgggtgaattttttaaggttaggagtttaagattaggttggttaatatggtgaaattttatttttattgaaaatataaaaattagttaggtatggtggtgtatgtttgtaattttagttattttggaggttgaggtaggagaattttttgaatttgggaggtagaggttgtagtgagttgagattgtgttattgtattttagtttgggtaatagagtaatattttgtattaaaaaaaaaaaaaagaagaagaataagaagtgttaagaagtatttgtttttttgattgaaaagtaatttttgttgggtgtggtggtttatgtttgtaattttagttttgggaggttgtggtgggagagttgtttgaggttaggtgtttgagattagtttgggtaatagaggtgttaggggtagtggtgtttgtttgtagttttagttttttaggaggtttaggtaggaggattgtttgagttaggagtttgaggttgtagtgagttatgattatattattgtattttagtttttgggtgataggatgagattttgttttaaaaaataaaatataaataaaaaattaatgtttattttttgtgattttaaaaattatatttatttgtgataaaataattaaattagaaaatgtaaaggaaatgattaataataattgtgttttttagataaatattgttaatatgtttatgtttttttttagtttttttttatatagatatttaatatttattaatttgttttgaattaaagatggttttttttgttttgtatgagaattattttagttaggtatggtggtttatgtttataattttagaaagttgaggtaggtagattgtttgagtttatgagtttgagattagtttgggtaatatggtgaaattttatttttataaaaaaatataaaaattagtttggtgtggtggtatatgtttgtgtttttagttttttaggaggttgaggtaggagaatagtttgagtttgggaggtagaggttgtagtgagttaagattgtgttattgtattttagtttaggtaatgggagtgaaatgttgttttaaaaaaaaaaaaaaaaaaaaaaaagttgttatgttgttattttttttagggatttttattttttttattttttgtttaagatttgttttgtaaaaggatgaggttaaatagttatgggagggtggtattggatgtttaaaaaaatgttttgtggttggtgggatttagaaataggttggggaggttttagtagagggtggattttagttgggggtggggggtagtaggggggttttttatatgttttttttgtgtgttttatggggttgtttgtgaggttgtgtgaattagagtttggttgggaagttatatgttatttggattttgattttttttggtagtatgattttagttaatatgtttaattatgtttttttttgtaaaatgggttaatagaaatgtttatttgagatatgatgagaaataaaggtgtttatagagtaaagtgtttagaatggttttggtatgataggagtttatatgttagtgttgttgttggtattgttattattatggtggtattggttgttttgttttttttttgtttttgttattttttttttttagtaggtttttatttatttgtttatttatttatggttgaggttttgtttgtgttaggtttggtgttgagaatgggggtagagagatgggggttgtgttttgttttttgatttaagggttttttttgtaatgtgaagtttttggagattggatttttaggttgttttattagtttttttttaggttagtttaatttttttgtgtttgttttttgagttgttagaggaagagagtgggaggaaggatggagtggggtttttgtggggattgagtggggggtgtgtgaggttttggaaatggtgtttgtggtatttatgtagtattagtttttgttgtagttgttgtttggagaatatttttggattttaggatattgatgatagaaggtggaatgttttttttggaagttattaagaggggattattgtggtggttgagtagagttgttgatttgtgagttgtggtttgattatagttattgtttttatgagtgaggttttttgtggttttttttttaggaatttttggttttttggtaggggatagtttagggttgggggtgggtagtggtgtttgtaggtttttttggagttagagaattttttgttgttgtggtggggttgtttttttttgtttttttttttttgttgtgtttttagttgttttgataggatgtttttggtttgagagatagaaattttaattttgaatggttttagtttttaagagaatttggagtttttttgtgtaaaatgagatgttttgagtattgaggatgttgtgggggattttttattttattatttttagttgtggtgttttttttggttataggatgttgtagttatgttgtagggaaggagagtttttttttttgtgagtttagggagtttttttatgtagtttttttattggttattgtttgagatttgatttggtggtttttgttttaaggagtagaaagggggtttgttaggttagggtggggttgggtgtgaggattttttttggttaatagggtttgtttaggtgtttgttttgttggggtagtagggaagggatttatatgtggtattgggatatggagaggtttttgtgtttgtgatggttaaaagggatggtgttttagttatgtttttatttattttgaggtttagtatggttatgttggaaatagtagtattgttttttttattgttttggtttgtttttaataggttagaggggtggggttggagtgggtgtttgatttgtggttggatttagttgtttgtggataggttgtgagtgaatttgtagaggaagggagatgggaatgttgggatttttttttgtattttttgaatttttgttttttgtgagttagatggggagtgtatttttgttttttttttttgggtattttttgtgttttttgttttaggtatttgatgttgtttgtttattttttttttttgttttttttgttggttttttttatatggttttaattaggattttttgtttgttggtggatgggtagagaggggagtttgttgtggggttttttttgattgggggattttttagtatagagttttttggtttttgtagggatgttgtgtgtgtttgtgtgagtttggtgtgttagaagtgttaagttgtagttgttttgtgtgttttttatattttttattttttaaaggttttgggtttggtgtttgtgggttggggatttgtgttggggtttttaggaggtttttggtgggagaggtagggtttttttttttttaatttgggtaattttgttttggtttgttgtttgtggaaagtgttttaggatatggtggtaggattggttggggttttggttttaggtttagttttagtttttgttagatttattttttttgtgtttttgtttattttgtttatttgtagggtttgtaggagtattttgagagttggtagggtggtttgtttggtgtttgtatagggtttgttggtgggtggttgaggttgtggtgaggtttttatggtttttttgttttgtatattttttttttgttgtgttgttttgttagtatatgagtttgtattgtttttgagtttgtagtttgttttttttattaggtggttaagtagggtggtagttagggtggtagagttttattggtttgtaggggattttttgtgggttgtaggtagttttttgtggttgaaggtgttttggtaggatttgtattatgatttttgttaaagtttatgtttaaggtatttgtgggtatttttgttttagatgtgagggttggtatttttttttgtatgtgaagtaaaggtttgtttgaaggagtgtgtggaagtttgggtgtgatgaaggtaaggattggtggtttattttttttgtatttggattttgggtggtaggtttggggtttttagtttttaatttaggagggtagttagttgttggaattaagagtgaattttagttgttgttgttatagttggagggaagaggggaaaggaggtgttgtaggggagtagagattttattttttttttgttgatattaggttgttggtgttggatggggttttggtaattgtggtaggagtggtgatgtttgatgatggtaataagggttttttgaggattttgagttgttttaagggttttttatttggagtaagtattttttttaatttttttaataatattgtgaaattgattttgttgttatttttattttattgatgaggaatttatagtttagagatgttaagtaatttgtttaagtttttttttgagtatggtagagggagggtttgaatgtggaaagtttggttttagtgtttttatttttaattattgttatttatttttttggttagttttttgattgtaaaatttgaggtttagaggagtgtagtgatttggttagttttgtatggtaggttagtggtagagttgagtagtgttttttatgttttgattttgtggttttttgaggtggtttatttttaaatatgttttttatggtggttttgttttttttttttttttgaatttgttagtttgtgtttaggtagggggagaagtagagtaattatgttgggtgggttgttgtgttttagtgttgtttgttttatatttgattggtagtagagtggtttttttttggtgtggtttggaggtgttagtggttatttattagtatagtttagttttatatatgttatttttaaaggatgttgatatagaatgaagtagttaggggaggtggatgttttggtatgagggtggtgtttttggtaatttgtagtgttgttgtttgtggttgtttttggttggtattttatttttttttggttgttttgtagttatttgagggaggttagtatgttgtttttattttaggatagtgtgaatgtagtagtgtaagtttgttagtgttgtattgtgggatttggaggtttttgtttttgagttttgtttttgtgtaatttttaaagtatggattttttaggggtttttatttttttatttggaaaaattttatattgtttagggtttgaggtagggttagagtatggagatgttgttggaggattaagggagaattgagtgtgtgtttttttggttttagttttgtgtgtgtgtttatgtatgggtattttgttatttatattggtttttatggttgggtgggagttgagttgagtttggtggttgtttttttattttgtgggtttggttggggagtgtgaggatgtttgttggaagttaatgtgtatgaaagagttaatggtggattttatttttttagttttttttttagtttttttagggaaagggtaggaatagagaggttttatttttagaggaaggggtgggtggggatatagtgttgtttggtatagttttttttgagttattttgtatgttttattttattgatttttgtagtttagttgtttagagtggatttagaaggtggagagagggtttttaataagtagaggatggagtgaatgtgagatttattattgggatttggtaaagtaaagagttttattttttttttgtagatgggatgggggtggggttggagttagtggggtgggggtatttagtaagagtttttttttatttttttattttttttgttatgggtttttttttttatgtagatttttagtttggaatgattagtgtttagttttttttgttttttttttgttttgttggagggagtgatttggtttttggttttggttatttatattttttgttttgttgtattagttttgtggtaggggttgtggtggaggtgggtaaaagttgtttttgggtagttagtttttattttgggagtgattgaaagtttttgggggtttttgtagggtgagttgtttattttggttttggtaaggatatttaggagagggttagggtgtttgtatttggggtatagtataaagaatagttgtaagtgttttttaggtaggagggtgttgaagtattgggaagttgggatttagaagtattgtttggggtggtgagtggaagatgtaggatatagatttatgtgattgtgtagattatttggttttatttttttggtttatagtggaggaaattagaggttgagagaggtgaagtgagttttttggggttatatagtttagttaggtttagggtgttgattttttgttttgtttttttgtgtttatttggttggtattagtatttttgttttgatatttttgtgtggtagttgttgtgattttgtgatttttttttattttattttagtggggttttgtgagggaaagaagaatgttttatgtagaagtggttggaaagtaagaagtttggagagaagtgaggtttttgtggtttggtttgagtttaggatttatggtttggtttttagggatggagtattgattttttttttttatatttttattttatgtttttaggagttttttatggggaagttggaatggatttgggtttagagattgtaaatttattttgttggatgtgtggttgtttttatgtaattaatttttttatggagaagttaggggatggtttttagtatttttgggggttttttagtgaggtgggaggattttgagaggttaggaggttgtttaagattttttgttttttagggattaggtgagggtttgttgattgttttgattttttgatgtttttggtggggagattttagaggggtttgttgttattattgttagtggttttggtttgtttagttatttttttggggtggttaaattttatgttgtaaaagtttaagtgaattttagtagtggtttgggagaattatttgttatgagttaaggatggagtttttggggaggattttttgttgttttttaattttttttgggtatatttttttgtagttttattttttgtaagaaagttaggtgttttttgaagtttttttttggttttaggttagaggtgatagtgggggttttttgtttgtgttggtgattgtggttggttgttggtgtttggttttgttttgtattgtgtatttattgaaggtggtattatttgggtttttttggtggttatgtatgggtgagtagtttatgatatatttgtttttagtattgtgtgggttggggtttttagaggggttgagggtttggatggttttgtaggggggtgtttttggttttgtgattgaaaggagttgaaggtttggagaagttgttgggttgaggttagtttttatagatttggtgaggagggaatagatgtttatggagttgttttaggtattgtatatattgttttattttgtgttgatagttaagaggttggttttttgttgatttttattttatagataatgtgtttttttagttttttagtggtggagttaggatttgaatttatgtaggtagttttttgggtttgtagttttattttttatttttttttaggatttatgttttggggttggtaggataatgatttttagagttgagtatattttaatttttagtatttgggattatgttaggtgatatggtagggttagttaaggttattaattagttggttttaaaatagggagatgattttggatgatttatatgggtttgttgttattataagagtttttaaaagtgtaatagattatttgaggggtgtagtgggagaggtttggaaggaggaaggaggttataagttaagaaatgtaggtgaatagaaaatgtaggaaaatgtagttttttttgtagttttgggagggtgtgtagttttgtggatattttttttgtagtttagtgaggtggagtgtgggattaatttgtgttgtttgatattataagtgtgtggttatttgttatagtagtgatgggaattgaatgttattaggtagtagtgtttttattttggaagaattaggataaatttttttgtggattttaagttttgggagattttgggtttttttggattgttttagttttgtaattataggaaaggttttttatgtttgtttgggagaagaaaattttgtagtaaatttatttttttttttgataaatgaaggtgagggtgtgggttggatatatgttttttttttgtggattttttttgttttaatatttagaattttgtagttgaaggagattttggggggttgtttgtttgatttgtaagtgaagaaatggaggtttagggaagttaagtgattggtttagggttatgtagagttatgttggaatattaagttagatagtttagtttttgttttaaagtgtttttttttttggttggggaggagggttggagggagtggattttgagtaatagtagtattggtaggggttggaagagtagttattgtatttaggtgttggagtttttggttattttttgtaggaattaggtgatttattatggtataggtttttttttgtttatttgtagttttgggggttttagggattagaggatattttggtttgagggttggggtttgagagaagagatggaagtatttttagtttggtttgtttttgtggtgttttgtaggtatatttggtagtttaggggttttagagaatttggttggtgggtgtttttattttgttgtagttgtattttgtggttagtagtttgtaggatttgggttgttgtttgtggttttgaaatagttattttttgagttgagtggggattaggtgagtagatttttatattttaattgttgtgatttttttgttttggaggttggtgggtagtttggttggtgttttatggtattttatgattggttttgttattaggtttgtgagttgtttttttttttttgggtattttgaatggtttttttgagagttttgttttgggtttttgtttttgtaggtttttgttgtttggggtgttttttttttttggaagttgggtttttttggggatttattaagaagggttttgttgagtgttgttaaattgttttatttggtttttatttgttttatttattattttattttaatttttatgttttttttttggttttaagatttgagtaggtagggtttgtgaggtattttaggttttttgatgttgttagtatttaggggattgttagtatatatgtagggagggaaggaatgaaggaagagatgatttggggagttttttagtttttatttgtaattggtatattgtgataaaatatttatggtattttattttttttatatattttttttttaaatttatttttatttgagatggagttttgttttgttatttaggttggagtgtagtagtataattttggtttattgtaatttttattttttgggtttaagtgagttttttgttttagttttttaagtagttgggattataggtgtttattattatgtttggtgaatttttgtatttttagtagagatggggttttattaagttggttaggttggttttgaatttttgattttaggtgatttgtttgtttttgttttttaaagtgttgggattataggtgtgagttattgtatttggtttttgtatatttataaaagagaatttgtttagaaaattttttagatgtatttttagggttttaaggtatagatatatgaagtttgttagtgagtagttgttgtttattttttttttttttttaatttagagtggtttgtgttttaagtggatagttgtttttttttttttggttttttgttgtttatgtttttatagaagtagggagaagaggtaggaaggtgatgtgtgattatttgttgggtgtttgtatagtgttgtttgtataggtgttattttttttatttgttattttttttgttgagtttttttttttttttgtagatgagagagtattgttttttagaggttaagaaatgggtttagagttatttagttgattagtgtgtagttagatttgaattatattttgttgatttttatgtttgtaggtttggtttgatgagatggatagttgggtggtggagattttgagattttggatggtttttaaatagggtttgtagtttttggatagggagagtttggtataaagggtttgtggagtgagttgggggagaaggtggtttagggtttttgtttttgaataaatagatggaggggttattttagtgtttttttagtttttggtgtgttgggtttttggttttgggaggagagaatggagttggtttttattttgggttgggttggtttgggtttaatttagataagttttttagtttgttatgagtgatatttttgtttgttttggtgtttttgttaaaaatatgaagggttttagaatttttattttggtttgttttttttttagatttggagtgggtttggggttgataatagttttatgttagatagtttgagtagttattagtgttattaggtttgatattgtggtttttgttttggagggaaaaataaggttttttttgggggattttttgttagtttgtgaaaataggtttggagttagttagtgtttttatgtttagatattttgtgtggtttttaaagtgtttttatgttgttagtttatatgattttttttaaaattttataagggagggtaggaagtttgagtaatagtttgttaagtatttatatagtaggtggttttattgttttttatttatagataagtaaattgagttttagggtggttattgtttgttttttaagttatttagttatttagttatggaagaggttatgattttttatattttagtgaagttgaagatttttttttttgtttttaaaaatgtttattttttagggtagtgaatatttggtgtttttgtttagtgtaagaggtgaatgtttgttatttttgtttttttttttttattagatttgattttttttttgtgatgggaatattttgtaggtagtttgttttgtttttatagattttgagaaatggggtttaaattgttggttgtgggtgggataggtgatattgtagtgaagaggtggagtatttttgtagtggggaagaaatatattttttttatttttttaggtttagtgtttgggggtttgtgaattaaatttatttaagataaattaatgagagaaaagatagatttaattatatatgtatgggattttattgaaaaatgtgatttaaaagagtaggtagaaggtggggtttgtgattggtttgaaggtagtgagttattttagttgattgtttatagttagttatagattagattttttgttttattgttttttttttttttatttgttttgttttttttgagttagagttttgtattgttgtttgggttggagtgtaatggtatgattttggtttattttaatttttgttttttgggtttaagtgatttttttgttttagttttttgagtagttaggattataggtatttattattatgtttggttaattttttgtatttttagtagagatagggttttattatgttggttaggttggttttaaatttttgattttgtgatttgtttattttggttttttaaagtggtgggattataggtatgagttattgtatttagttaattagttttaaaaaaaaaaaaaaaaaaaaaagaatttagggtttgtatattattttaataggaaaaaaggaaggggtgaaagtatatattatgggttgggtgtgatggtttatgtttgtaattttggtattttgggaggttgaggtaggtggattatttgaggttgggaatttaagattagtttggttaatatggtgaaattttgtttttattaaaaatataaaaattagttgggtatggtggtgtatatttgtaattttagttatttgggaagttgaggtaggagaattgtttgaatttatgaggtggaggttgtagtgagttgagattatattattgtattttagtttgggtaatagagtgagattgtgttttaaaaaaataaataaaaaaaaaaaagtatatattatggtaaaataaatgagtttttggaaagataaataggtttttaggagttgagatgggagatgtgaagttttgtgataatgtttttttaggtgtggtgtggaaattatttatattttttagggaagagttagttgtttttagggagtagatttgggtttgtatattattttaataggggaaatggaaggggtaaaagtatatattatgggttgggtgtaatgtgtttagtgtaggaggtagatgtggtttatggttgttgttgaaattagtgtagggtttgattgttttgtattgagtgttgaggattttggttttgtattagttatgagtttgtagttttgggatatatttgatgttggtttaaggggaaatgaggttggaggggtagggtggttggattggatgtgggtttggggttattgttgatttataaagtggttattatatgggaataatagagttggttatagattataattagtaatattatttaaaagtaaggttatatttttaataataagttatattttaagttattattaatttataaaatatattgttggtataatgatagttttttaagaaggatataaaaaggtatgttgggttgggtgtagtgatttatgtttataattttagtattttgagaggttgaggttggtggattattttaagttaggagtttgagattagtttggttaatatggtgaaattttgtttttgttaaaaatataaaaaaaaattagtttggtgtggtggtgtatgtttgtaattttagttatgggggaggttgtggtagaagaattatttaaaatttgggaggtggaggttgtagtgagttgagattgtgttattatattttagtttgggtaatagagttagattttgttttaaaaaaaaagaaaaaaaagaaaaaaagtaaaaaggtatgttgaaggtatttgtttgtggaaagttgtaatttgatgggaggtagggtgagtattttttagaaaggtggaaatgggtttttttgttatagagatttataaatatagattgaggtttgtagtttaggagatttaaaagaggtaaaggtgaataagagttaaggtttttaagttagggtttgattttgggggtgggggttatatatgatggaggatgttaggagggttttttggaggtggtgatatttattaggggggattttaggtggggtttgtgagatagtaggatttggttgaagagtgtaggttttttagataggagtgggaatttaggtttgaaaatgagttggttagattgtaggggtttttgaatgtaagggaagaattttaattttaatagaggagtttgggaagttgtttgggaaaaggagtgataaagtgggaggggttttttagtagagttttgtatgggtaggagggagtgagatgggaggtgggtgttggtaagggatgattttagtggtttaggggagtagttatagggtggaaattaattttgtggggtttgggtaggaagggattgatttgagatattgggaagaaatagttagtaggattttggtgagagggttgggggttggggaggggggtgtggagagtgggagtttgagtttttgaaaatagatagtgttttaagggggagatttgaggtaagatgtggagaggtagttgagttgggaagttggaatggaggtgtggttattttaggagattaagttagggggtgaggggatttttgggagttatttagattttagtattagggaatatggaggggagaaggaggggagaagaattagttggtgtgtgttaggtattgtttttgaggttagatggggtggggttggatattggttatgaggatttttttaagagttgggttaatagtgagatgggtggatattagatggtttgggttaagaagtaagtgggtggtgggaagttagaagttgtggtgtagatttattttgagaggttgggttgtttagatagggagaaagtttatagtttgaggaggtagataggttaaaggaagagggtttgtttgtttttgagattggggtattttgaatgtttttttaggttaagtgagaagaaattagaagaggaatatgttatttaaatgtgttgaaatagtttagtagttgtgttgttttatagaaaatgtgtagaggtttttttgttttattatgtttgtttggggatggtttttatttgggttatttagggtttttttagtttgttaatttaagggtggtaggagttgtgggtgtttttagtttttttttaaggttggtttgtgggtagaaatgtgggttgttttggggtgttatagttataaatgtatattagtttttagaattatatttttgttttttagtttttttttttgtatttttatgtagaagtgtggttgttagtttataaaggatagggagggatattgtttttggtatttgatgggaagtatttgttgtattttattggggtgttgtttaggatggattggaaaagagttggtaggaaggttgagttttgtgtttataatttggtttggtggtggttgaggagtttggtaggagtagagtgtaggatttgggaattgggggttggtgtatgtgtgtatgtatgtgtgtgtgtgtgtgtgtgtgtgttgggtgggtagggaggaagttgtgaaattatatttttttttttttgttgttgtgttgttgtgtgttttagtagtatgtgggtgttattatattttttagtaggtgttaatttttaagattgttttgggttttttttttagttggttgagttggaggtgggagttttaattgttttttgtggtttttagagtgggattttgttgtgggataggttggttaatggtgtttttttttttgtgatttttttgttgggtgggttatgaggaaggattgtgggtgttgtttatagataggtggatatgtggtaaggatattttgggattttttttttgatgttttttgaagggggtatttttttagttttgagatgagtttttgtggatgtgggaagtttattattttaagagtagtagttttggaaaatttaatatagaattttgagtaggggtgggaaggggttttgttttgtttattggttgtttggtagagttttgtataaggaagtgtttgtgttgttgtgggtggaggaatggattgagggttatatttgttttttgttgttgttgtaattgtttattataaatttagtggtttaaagtaatagaggtttttttttttatagtgttaagggttagaagttgattagttttattggattaaagttaaggtgttggtagaatttatttttgttttttttagttttgggtgggaggttttgttggagttttttggtttgtggttgtatttttttagtttttgtttttatttttttatagttttttttttttttgtagttagatttttttttgttttttttttttttttttttgagatggagttatttaggttggagtgtagtggtataattttggtttattgtagtttttgttttttgggtttaagtgatttttttgttttagttttttgagtagttgggattataggtatgtgttattatatttggttaatttttgtatttttagtagagatagggttttgttatgttggttaggttggttttgaatttttgattttaggtgatttgtttgttttagttttttaaagtgttgggattgtagttatgagttattatatttggtttgttttttttttaaaggatgtttgtgatttggggtttatttgggtaatttttttattttaatatttttagttatatttatagagtttttgttgttatatgaggtaatatagtttgggaagggagagttatttagtttattttaggggtttgtggtgtattttagggtttttttgattttaagatataaagtaagaaaataaattggtttaaggggaaaaaaggatatgttgaattttgttgttttaaatgtatatttttttattgtgttaaaatgtatagaatataaaatttgttattagtaatattgagtatatttatagtgttgtgtaattattagtattgtttagtgttagaatttttttattattttaaagggaaattttgtatttatgaaggatttattttttatttgttttttttagtttttggtagttattagaatgttttttgtttttataaatttatttttaataagtgtaattttgtgtgattttaaaataaataaatatgagtatgatgagttgtttattggaaggatatttatgtggggaggttggtgtgtggagtgtgtaggtttttggatgggtaggagttgaaggggtgtggatgtgttgtttttttttttttttgttttttttttggggttattgtttgagtatttttttttgtaaatggttttaaataatgttttagtttttatgtttgtattgttttttagttttaggattttttattaaaaaatattttaagttttagatttatttttgggaaaattttaatggttttatttttttttttgagttagttagattttatggtttgtggtgggttgtttttgagttttgagtatttgtgagttagggaagtaggataggtatatttagggaaggggaagagttgttgttagttatagtaattgatatttttggaattgtttaagagatatttagtgtgtgtttaaaatatttatttttttttttgtttgttttttgagatgaagttttgttttgttgtttaggttggagtgtagtggtgtgattttagtttattgtaattttttttttttgggtttaagtgatttttttgttttaattttttgagtggttgggattataggtatatattattatgtttggtgaatttttgtatttttagtagtgattgggttttattatgttggttaggttggttttgaatttttgattttaggtaatgtgtttgttttggttttttaaagtgttgggatgataggtgtgagttaatatatttggttatatttattttttaggagaagttttgtattttttgaaagtgaaatgtttttaggtgggtgatattgatggtgggatttgtggttttattagtgttttatgagagatgttgttgtgtgttttattaagttgtattttattgttttttaaatgtggtttgtagatatggtgttgagaatgatttgggaggtttaaattataatatggtttaaattaatagttttttgatgatttggtattattttaggattaaattgagattatttgaggatgggtgtggtggtttatgtgtgtaattttagtattttaggaggttgaggtgggtggattaattgaggtttgtagtttgagattagtttggttaatatggtgaaattttatttttattaaaaatataaaaagtagttgttggatatggtggtgtatgtttgtagttttagttatttgggaggttgaggtgggagaattgtttgaatttaggagatggaggttgtagtgagttaagattatgttattgtgttttagtttgggtgatagagtaagattttgttttttggtaattaaaaaaaaaaaaaaaaattgagattttttgagttgtattgtttagtatgatagttattggttgtatggggttatttgaatatttgaaatgtggtgattttaagtggagaggtgttgtgtgtgtgaagtgtattttgggttttagagttttagtaagggggaaagaaaagaatattaaatatttgttatttttatattgattatatgttgaattgataatattttgggttttgttaagtgaatgatattaaaattaatattatttgtttttatattttttaatgattttttttttttttttttttttttttttttttaaatatggggttttatattgttgtttaggttggagtgtagtggtatgattttggtttattgtaatttttgttttttaggtttgagtgatttttttgttttagttttttaagtagttgggattataggtggttgttattatgtttggttaatttttgtatttttagtagagatagggttttgttatgttggttaggttggttttgaatttttgattttaggtgatttgtttattttagttttttaaagtgttggtatgataggtgtgagttattgtgtttggtttgtttttatattttttattgtaggtgttggaaaatgtaaggttgtgtttgtggtttatgtgttgtttttgttggagggttggattgagggttagttgagaaggttttggggttgttttatttgaatgttgagtgtgtgttgagtggtagagaattttgagaagtgttgaaggatagaggttttgtgtgggggatgtagttttaggttggagatgttttttttgtgttttggagatttttatttggtgatagtaagaggaattattgtaagaggggtggttattttagtaaagtatttaggatgttggttttttagtttaggaatttagaggtagaggaggggaggaggttgggtttggaggagagtagggttttgggttttgggaaaagtttggggggttagaaagttgggggatagattgaggttagaggtaaagagaagaaggtttggagaggagggttaaggaagaagggttttgtttatggggagggagaggtttatggggtaggggtgtggtgggagttgtatttttgaggttttttgttgattttgatatttggttagaaaggagttttttttggtattttttgttagtggtttttggagttgttttttaggggttagtgatgagggtgttttgggttgggttgtagatagtggaaaagataggttttttttatttttagtgttggggaaattagttttttggaggaagggggagttgtattttttgagtggttgtattttttggtttagatgtgtgtgttttgttgtaattttggtgattggtgttggtggtgtttattttatggatggggaaggttaaattttatagatattgagtgataggtttagggttttggattttagtgtttgatttagaatttaggtttttgatttgttattagttttttttttatttagatgggaatagggattttgggtatgtagtttttttttagatatttttttggttttggtttggtgtttggagattagtagtagtagttttttatggttgtttattgtgagggtggggagggttgtgggattaggaggttttagggggaaagttggttatgaggagtgggaagtgatgggttagatgttagtgattgttggttggggagttgttggatgtggttggtttgtttggttagtgtggtgggtgttttggggttttagttatttttagttatgtgtgggggtgtgggatgggaaaggtaagagtgtgtggagtttagttagtatttaatatgaggttttgtgggggttgtttgagggtgtagtttttagaatttagtttttggtttttagaaggtgttattaaaggtttttttttatttgagtgaattttttttagtttttagtaagtttttggaatgagtttatttttaggtgtttttttttagtgtgggagtggttatgtttttgttgggagtgatttatttgggtttagaggttgtggtattgagatgggtttggtagattttagtgtttaggtttagtttttatagtgttagtttttttttttggggatttttttgtttgtgtttttttgggttttagtatattttaggtttgtagggagggggagaggaagagattgatttattggttaggttttttaggggttggagaggttggagaggtaggagttggattagatttgaatttagaggtttttggaggaagagtttagggtgagttgtgtttttattttttgtttttttttttttgtttttttttttttttatggttttagttagtaagtatttggggtagaggggataaatttaggtggttgtgttttagttttggttgtaggtttgaatggttttttggggtggttggttatgttttttgagagtttagttgtggtgatgtttgagtaggtaggtgggggagtatttaggaagtaggggtgttaggtagagtataaggagagagggtgtttaggttagttttaggatttggttgagaggagggggttttttatgggtattgtttttggtaagtatagggataagggtaaggatggtatggttagaggtttttgggagttttttttttttttttttttttagtagtttttttttattttttttagggattttgttatttttttttagtgtgtggtagttttttggtgttttttttgtgtttttaggttgtttttgtgttgggtttgttgttgggtgtttttatttttgtttgttttttttttttgttttttttgttttgtttttttggagtaattttttattgagtttttttttttaggtagttgaggtttttttttatttttgttttgtgttttgggaggttttttgttttgtgattataaagtttttttgattttttgtttggttttgagttatgtgatttggtgggtgggttgtggtttttggtgtgtttagtgtagtttgatgttttgttgttggggtgagttttgtttttttgttttttttagttttgtattattggtttgggggtttttaggtggtgtggttgtgaggtggattttgatggttatggtggtggtgttgggagttatgttgtttttgggttttggtttgaggttggtaggattgagtggggtttttaggagaggggtggtggggagtttgatttttatgtggggattagatttttggttttaaaatagaagaatagggttttgtgtggttatagttatttttttgtaaatatttggttaattaagttgagtggttaagtttttttgttgtttggagttttttggaatatgttttttttttgtaaggggtttttttggtttttaggagggttaggaagaaatttgaattggttattgttttttttaaaattattttgtttaagttattatttttttgggtttttgaagattggttggttggaggttggagatagttttaatgtttgaaatgttgtaattgaagttttttgtggtgttggtattgggatttagggagttgttgttatagtgtagttttggatttttggatgtgttggatatgtgtagggtgtttttgggaggagtggggagggagggtgttgttggtggggttggtttgtgtgtgttttgtttttttataatggtatgttgtgtgttggttatgtagaggtatgttagtgagtaggggttgagggatttttttaatggatttgtttttagagggtttttttatgttgggagaattttagagattaaattatgtagttaatggggtggtttttggttttaaagtagggaggggtgaggagttttgtaggtaatgttatttgtttttgaaatgttgttttagtgattttggggattgatttagtttttagtttgttgtattttatttttggtttttttttttttgtttttttatgtgaaatttgttgtgttttggttagaggtttggggaatagttttttgtttatttaagataagtttgtaattttttttttggagaaaaatatgttatttggaagtaggttgagtagtggttttttggtaggtttgtttggggttgtggagatagtatttgttggattaggatggagttggaatttggtttggattttatatgagaaaatttgttggaagaggaggaagtagaaaaaggttttattttttaataatgttgtgggttttttttttttatttattgttattttgttttgaaatttaatggggttatgtgtgtttttatgaatgttattttttttggttaatttttttggtagttttaggagtttttttttaggaaaaggaagaaggtgtttgtttagtatttagtatatgagtttttgttggaaaggtgggatttttgtttttttttgggttttttttaggttgagatgtggttaaggaaggtttgtggtgtggtttgttttttttaatgtttgtttttggagatttgagttgttgttgatttttagtttgttttttttgttttttggttatttttgtgttggggtggttgagatattattgtattggttattttgtgtttttattagtttttgtttttgtaggttgttattgtgatggtgatggggttaatttagttgtggtggggaggatttattgtgtgtgtttggggggtggtgtggggtattttgggatgagaagatgtgatttttgttttgagagttttgttttaatggaaggtgggggtatagttgtaggtagaagttattaagtattgtggttagattagtattttatgttaaaaatggttttgttggttgggtgtagtggtttatgtttgtaattttaatattttaggaggttaaggtaggtagattatttgaggttaagagtttgagattagtttggttaatatggtgaaattttgtttttattaaaaatattggttaatttgggtatggtggtgtgtgtttgtaatggtagttatttgggaggttgagataggagaattatttgaatttgggaggtggaggttgtagtgagttgagattgtgttattgtattttagtttgggtaataagagtgaaattttgttttaaaaaaaaaaaaaaaaagttttatttgggtttgggatttgttttttgaatattgggtttattgtgttttataaggatttttattttggaagttttagatttatttgggtaattagagtttttgggttgattattttttagttttggttagttttttgggttattgtatttttttaattttttgttgtgttatggttggtttaagttgtttttattagataatgtgaggtatttttataggaggggataattttgtttttaggagttttttttttttgtttttaggtttggtgtagtgtgtggtttttttgttggtgttaaaggttttaaggtttttttaagaagtttgttattattattagtagtttttgttatttggtttttttgtatatgtaagttttttttatatattttggatgtttagggtttttgttttttttttttggttgggagtgtgggaagagggttttattttaatgtttgagagtagggttaatggttagggtaagttgtgggggtttttttttgttggtttttttttgtagtttttattttaatatagagtattgatattatttgggttttgggaagatttggaggttgattattttggaggtttttagtgttttatagttattttttggggaagaggttttttgagggatttgtggtttttggttgggattttagttttagagttttgttttttggtgttgagttttgatttgtttattgagtgttagtttggtttttggataggtagggatttgtttttggagtttagtagagttttgggaagtttttttaggagggtttttgagggtggtggttatgtttagtttgttgtatgtgtgagtttgtttgatgaggaattggttgggaaggtgtgggtttaattataggtttatgagggttttttttgtttttatttaggaagtagtggagattttggtatatttagtatttgggtttgtgtttgtttagttgttggtggaattatgggagttttgttttggggtttgtagagtagtagtgggaattttttttattttagttttttttagagttggttgtttaaatttgttgttgtttagtttttttttttttttttttattaattttgggaattgtatattgtttattttattgggttttggagtgggtgtaggaagagagagtttaatatttagaggtttgggttttttgtaggtgtttgagttgttgtggtttgagttgggttttttgttggaattattatagtagatttaatgatttgtttgtaggagttgttttattttagttgattttggggttgtgggaaggggttgggttttggttttgttgggggtggggggttagtgtaaagggtttgaaaagtggtagaggtgatggtttatttgttttttttttggttggttggtttaaatgtgattggttttttttttttttttttttttttttttttttttttataaataatattaaatgtgatttgttaatgtatttatttgggtttagtagttggattatgggtagaagtattttagatttgttattttttttaagttaagggtggggaatattttttgtgagattttggtttttgagtgtttaagattgtttttggaattttaattttgggttggttttaggggattgatgttgatggagttgttgatattgatttttggtttttgtatggtttttaggaagggggttttttgttttttgttttgttgagtttggttggtagtattttttttttaggtttgtgtttttggtagggtttgttgtttttgttttgttttgtgggtgttaggttttaagtattaggtgatttggttattgaatggttattgaatagttatttttgttggtgtttttagtggaatgtgtatggatgtttttttttttttagatttttgttttttattttttagtttttgttttaggggttattataggattaggaggtatgtagatgtgggtggtatatttattgggtagatttagttttgaatttgtatgttttttttaagggggtttttagtgggtggggttgatggtgttgtttttttttttgttattagaatggatatgaggattgtgttttgttgatttatgttttgagtttttagatgttataggtgtttgtttaatgagtgtttgaatgaatggttagtattgtgtgattgtagatttttaatttttatttaaatagtttgtggtttttgtgaggttattttgagatagttttataagaatttttattttttttgtatgttttgtataaggtttttttggggggttttttagaaaaagggttaaagagtagtatttttttggggatttgaatatgattttttttggggtaggggattgttttggaagatttttggtattgttttttatgtgttatgtgattaggagggttttggggtaggatggtgttttttgtgttttgtgtgttggggttggaggaaatattgtttgtggttggtgttatttgttagttttgaagattaatgatgggttggatagtggttttattgagtgggagggagaattgttgttgtttgtagttggggggttgggtgggtgggagttgaggttagggagaatagtgtagatttggtatggagaggtttggaggaggagtagggggttttagttatttagggtgtagggatgttatatgaggagtaggtgtggtgtgtgtttttttgtgggttttttattttttggttttgttatttgtattaggttttgtggtgagagggtatagagtggaggaaggtgttgtggttagggtaggttatatgttgtgttaatggattgttgttatttgttgtttttgtggttttgttgttaggattttttagtattaggtttttattattaggtatgggttttataggtattattggttttttgaagttagggatagattttatagataatattgagtttttgtagttagggatgggtttttatggttagtattagattttagggattagtattgggtatttatagttagggataggtttttatggttagtattaggttttagggattagtattgggtatttatagttagggatgggtttttatggttagtattagattttagggattagtattgggtatttatagttagggatgggtttttatggttagtattaggttttagggattagtgttgggtttttatagttaaggataagtttttatggttaatattagattttagtgattagtattagatgtttatagttagagatgggtttttatggttagtattaggttttagggattagtgttgggattttggatgattgaaggagggtatggttgattaaagttgtaggagttagtttggttattttgaggtattaagttattattgtggttttaggggatttagatttttttatttgtttttttgaattttggaattagatatatttgggtttagtttttgtttttggggttgtgtgtttgggatggttgttttatttttttgaagtttagtgagatggggatggttgtatagggtttggtatagatggtatttgatggtatagggttatttgtttgtatttatatagttttggtttttgttttggttgtgtattgagagttttatgtttagatttttgttgagtttttaagtttttggttatgttttaggttttttgtgagaagtattattgtatggattatgttttgggattttattttgggttgggaagtttgttttatttttttaagttttttttagaggtgttttatgttttattatttttattgtttgaggggttagataggggaatttagtgtgggaggtttagaggtgttggagtagatgttaagtgagttttgtgtttatgtgttgggttttggtagatattttgaatgagttttttttttaggaaggagattggggttttagtttaagttgtggttttaaattttgtgattaagagtggagaaaaggtaagatttttttttttagttttttagaatagttgatagtggtggaaatatggggtttatattgaatttttttgtaatttgttgaagagaatttagtttatatttttaggggtggaggtttggttgatttggtagtgtgtttgtttttttggttatagtttattttggattgggtattttggtgtttttttttagtgatgtagtgaagttattatgatgtgtttagttggtgagaaagtgttttttgtaatgttttattttttttagagggtgaataagttttgtttattataaataattatttatagaatatatgaggtttaatttaattttgggttatggtagtgttttttgggtaaatttatgtgttattttagttagagtttgtgtttttataggttttttggatttattttgaaggggggttggattttttgtttgttttgatgagagggttgtaggatagtttttagtgagtttttttgagggttgtaatttttttttttggtatttttttgtttgttaggaatgttttaagtttttagtagaagtttatttattatagttgttttttattttgtttattattttttttgtttttatttatttagtagattttgtgtatagtttagtgtaggatttagggtgggaaggtgttttgggtgggttggagtaaggtttttagttagggtggggttttaaggtgggtttatagttaggattgtgatttgggaggtttttttttgttttgttttagttttggtattgttgttgtttttgtgtttagtggagatttattggttttaggttttaaaattttagtgaggtttgtagatagggaggagttttatttgagggtagagtgattgttgggtttatttgtttgttatgaattatgtggttttagatttgttatttttttttttttagagttatggttttttgtttgaaaaatggataatgatggttattatgttagggattattttgaggataaatggggatgaaattgaagaggtttagtatggaatttggatatagaagtgttaattgtgtgttattagttgtggtggttgttaaggtttaattatatggtagttatgggttgagtggtgggtgggaagtggggagtaggagtatgtaagatgggtatttttgaagtttttgatttagtgagataagtatatatttagttttaagatggagtgttttaggaaggtggagattgtaaaggttttgtggtgtaggagtgtgagttgtatttttgggttttttagaattttattagagtttagggaggaggttagtttagatataggggtaatgggagagatgggagtgagaaaatggtttggtgtttggaagtggagtttggaaaggtgggtgtggggatagaggagggttttgggggttatgggtttatgtgtttaggaggtggaggtagtgaatggggttatggttggttttatatgtggtattattagttttgttgagtttgtatttgttttttaggttttttgagtgttattattatttggtattttttggtttgatttttgttttttgtttgtttgggaagagtgagattatttgtttaaagttttttagttgtttttaattattttggttgttttttggttttgtttagggttagttgttgatttgaattgtttggtgttatttttttagatttttggggttttgttttggtattaatagttatttttatttttattatttatttgtatatttatttagtagtgttttttgggtatttatttagtaatattaaggtgttgagatgtggttgtggttaagatttgggtttggtttgtgaggattttgtagttgttatttttttagagtatagttttagttaggtatattgtggggtttagaaagagaaattaatatattgtgtttgtttattttgagttgttataaggaatagttgaggttggggggttatttgatttatggttttgtaggttgtataagtggtgttagtatttgtttggtttttggggaggttttaggaagtttttttttatggtagaaggtgaagggggagttggtatgttatatggtgagagagagaatttttagattttttttttttttgaaatggagttttgttgtgttagttaggttggagtgtagtggtataatttttggtttattgtaattttagttttttgagtagttgggattataggtgtatgttattgtgtttggttaatttttttgtatttttattagagatggggttttattatgttggttgggttggttttaaatttttaattttgtgatttatttattttggttttttaaagtgttgggattataggtgtgagttattttatttagtttttttagattttatagtaattagattttttggattttgtgattgtggggagggtattaaattatttatgagggatttatttttatgatttaagttttattttttttaggttttatttttaatattagggattatattttagtatgagatttggaggggataatgtttaaattatattatatgtgatttttttgtgtgtgtgttagtttttatatttggttaagtagtagaagttttttttttgttttttgttgagagagtggtgggggagaaatgatttagggatgggaggttggttttttgaggggttttggtgtttgtggagtgggagtgtgggaaggtttttatgttgtgtgtgttgtgttgggttggttttttatagtttattgtggtgttttttgaggattgttggggaggaaagagttaattaatttggggatttagttgttgaagttattattaaatttgagtagtttaggggtttttttttttttgggttttatgttatttagtatagtggggtttaattgaatttttttttattttttaaggtttttggttggtgtggttggggtttgggatatggggagtgagagggtttgggttttttttagatttggagtgggtttattagaaatggtttaggaaattgtgggggttatttttagtagttgggggtttttgtggttatttttttttggttttgttgagtagttttggtttttggagtttttagtaagggatgtgggggtttgttaggttagggtttttattgttgttgttatgtatagttgtattttgtatttggggagtggggtgttgagtggggtgtttgggaggtaggtttttttttgttttttttgtttagagattttggggatgagttgagtgagatttttttggtttttgattggttgtgtttttgttgttattttttattttttttaagtggaggtttatgatttttttttttatttaaaagggttatttagtgatttagtagattttagtttgtgttatttagggtttttttaaaaatttgtggggaggttgggtttggtggtttatatttttaattttagtattttgggaggttgaggtgggtggattatttgaagttaggagtttgagattagtttggttaatatggagaaattttatttttagtaaaaatataaaaaattggttgggtgtggtggtatgtgtttgtaattttagttatttgggaggttgaggtaggagaattatttaaatttaggaggtggaggttgtagtgagttgagattatattattgtattttagtttggatgatagagtgagattttgttttaaaaaaataaaaataaataaataaaaataaaaatttatggggggatttttgtgtttattggttggtgtgaggagagggtgaggagttgtagagaaggtattaggttgaggattgtttttatttttgggttatagaattgaaggaggggatatatgaaagatgtttttagatttgggttggaggttggggatatttgagggtaaggatgatgttgtttttgtttttgtttgtagaggagtgtatagggtttattagttttttgttgttgtttaagtgatagttttatggagatagaatttatatattgtgatgttgatttttttaaaatttatagtttaatggttttgttgtatttataaagtgattgtattagggttatttagagaaatagaattaatagaaggtgtgtatgtgtgtttagataaagagatttattattatgaggagttggtttattttattatagaggttggtaagtgttaagattggtagagtaaattagtaggttggagatatgggagagtttatgttgtggttttggtgtttatttgaaggtttaagatttaggagagttaatggtgttgttttagttttgagatttaggaaaagtgtatgtgttagtttgagtttgaagtaggaaaaatttgatgttttaggttgaaggtggttaagtgggaagaatttttttttatttaggttttgtgtttttttatttagatttttaggtttttgttataaaattataaagatttgattagaataaaatttgagaaaaaattttttttttttattggttttggatttattggttgggattttggaaattagattgatagagattaataggaaataagtataataatttaagtaagttttatttgatattgagtttttataaggaaatgaagatttagagaaattgttagtttgagtggtttttgttttgttttgagataaagttttattttgttgtatgtttaggttggagagtagtggtttgattatggtttattgtagttttgattttttgggtttaagttggggtttagttgttggttttgggagttgttttgaatttatttttaagttttagtttagatttttaagtagttgggattataggtatgtgttattttgtttggttaattttttattttttgtagagatagggttttattatgttgtttgggttggttttaaatttttgggtttgagtaatttttttgttttggttttttaaagtgttggggttataggtgtgagttattgtgtttggtttaggtttgaatagtttttatttgttttgtttgttttttaaatttgtttgttgtttgttttgagtagtttttttgtttattttttttgtttgttttttgtttaggttggagtgtagtggtatgatttttgtttattgtaatttttgttttttgggtttaagttatttttatgttttagttttttaagtagttgtgattataggtgtgtgttattatatttggttgatttttgtatttttagtagggatggggttttattatgttggttaggttgttttttaatttttgattttaagtgatttggttattttggttttttaaagtgttgggattgtaggtgtgagttgttgtgtttagtttaggtttgagtgtttttatgttgggtttgatgaagagtggaaagttgtgggaaattgtgatagagtaataaaagatgagttgaatagtgagtttgtgggggttttggtaagatttgtgtattggggttttttttagattttttgtttttggagatgaggttgtttttttttgttgggtgtagggagggtattttttatgtgaggggtttatgatttattttagagaaggggtaggttagtgagttttttttggatttgttattttttaaatttttttagttgaaaatatttattatgttaaggtattgtattttggagtgtgtgttttaagttttgttgtttttaattgattgggtgaggtttatttttattagagtatatagtttgttttatttaggtttttgattgtattttttttttgtttgttttgagaatatttattagtagtgtttgtggttgtagtgtttattttaagataaatttgttgggaagtattttgtttttattattatttttatattattttagtatattgattttggaaataaaagatattattttgtttatagtattttatttttagtagtggtattttttttaaaaaaaaatggtaatttttagttgggtgtggtggtttatgtttgtaattttagtatttgggaaagttgaggtaggttgattatttgaggttaggagttggagattagtttggttaatatggtgaaattttatttttattaaaaatataaaaattagttaggtgtggtggtaggtatttgtaattttagttatttgggaggttgaggttggagaattgtttgaatttgggaggtagaggttgtagtgagttgagattgtgttattgtattttagtttggatgatagagtaagattttattttaaaaaataaataaataaataaaatttaaaaaaaaatagtaatttttgattgttgaaaatgttaaattttagagaatatagtatttttataagtgatgttaatattgtttttgattagttgttggttgaagatttatttgatgaatttgatttttttagaatagatgatttagatgattttgttgttttgtttagaaataattgtaggaataatttaaaaaattttttttttttttaatttttttgttttttgagatggattttttttgttgtttaggttggagtgtagtggtatgattttggtttattgtaatttttgttttttgggtttaagtgattttttagttttagttttttgagtttagttgggattataaggtgtttgttattatatgtggttaattttttgtatttttagtagagatggtgttttattaggttgattaggttagttttgaatttttgattttaaataattggtttatgttggttttttaaagtgttgggattataggtgtgagttattatgtttggttagtttttatatttaatttttatatagagtatttagttagatttgttttagttttaaagagtgtgtttatgtaaaattaagtgagtgttggtagtgagttgaattttttaaaaggtaaaagggttaaatattaaatttatttaaaaatatttttatagatatatttagaataatgtttgattggttatttaggtgttttatagtttagtttagttgatatagaaatttttttttttttttttgagatggagttttgttttgttgtttaggttggagtgtagtggtgtgattttggtttattgtaagttttgttttttaggtttatgttatttttttgttttagttttttgagtagttgggattataggtgtttattattatatttggttaatttttttttttgtatttttagtagagatggggttttattgtggttttaattttttgattttgtgatttatttgttttagttttttaaagtgttgggattataggtatgagttattgtgtttggttgatataggaaattaattattatagttatatagttattgttattaattttagtatattttattatttttaaaagagattttgtttttattagttaatttttatttttaattttgggtttttagtttttagttattgtttatttgtttttgtttttatgaatttatttgttttagatagtttgtataagtggaattgtatagtatgtggttttggtgtttggttttttttatttggtagaatatttttaaggtttatttatattgtagtaggtgttggtgttttatttttttttatggttgaataatattttattgtggatagattatattgtgtatttttttatttgttgatggatatttgggttgtttttgttttttggtataattttgttgtgaagaattttgtagtgagtgttggtttataggtttttgtgtgaatatgtttttattttttttgggtaattgtaagattatgtggtttagttaattagtttttaagttatgtgtttgttgagggatttaggtttggtgggggtgtattgttgtgtttggttagttaggtgttgtgagtttgtgttgtagttatttttttgtgttgtgttttgaggttgttttgttggtattgggtattgtgagttttaggaggttaaagttttttttgttttattttgagtttaggttttgttttatgaattaggatgaatggatattgaattaatgtagggatgggtggggttggggtggggatgtagagtgattttgggggtttgtagttgggttttggttgttgatttttagttttttttgtttgttggagtttagaataagttagaaaggggaaatgtaaagtttgagtgttttttttgtggtagattggtaggtttgggtgggtgagttatttgtagttagttgtagtgtgagagaggaagtgggaggggagggagagggtgagtttggtgtaatttatttttggaaggaggttgggttgaggttgggggaagtgatttttatttttttgagaggatttttttttggggttaattttaaattaagggagataagatttttttgggggaggttggaagtgttggggtttttaggtgggtaggttttttagggttaatgttttggggaagttataagttattatgtttttggattgttatatatatatatatatatatatatatatatatatatatatatatatatatatgagtaaattgtaatataaatgtgtgtttatgaaagtgtttattttaaattattatatagtttgtaaagtgaaggttttggtttgtatttgggtatttattgtttagttagttggtaggtagtttgtattgtagtttgttattattttttagagatgtagttgaggagtttagttggtttggagggtttagtgggtgtagttttaggaaagtggttaggtttgggttaggtttttttttttttttagttttgggagaaattattatatgaatgtagtttttttttggagtttgggttggaagggtttgggaggggataggtttttattttaggagtttttaggttttggttgttgtttgtgttagttgtgtgagtgtgagtgagttaggggttattattgggtggaaggaagaagtgggtattttttttaggaggttattgttggagttttatagtaggttaattttaggttttgggtttttgggaggaggagaaagaagagaagtaggaggtgtggagggtaggttaggattagaaggtatatagggttggggtagtgtgggagattttgggggtttttttatttaattagttaatattatagtgtttataagaatatgttattattgtagttttattattttgttttgattttagaaggtataattgatgattttagggaatggagaatttgaggaaggttttgtaggagagggttagatgtgattgagtaaatgtgagttgtttgtaaattgtagagtgtatgtatagtattggttagttttggggttagtgtttttttggtgtttagtttggtttttgtattttttagtgtttggttgggttttgtgggggttagggttgggtttggtatattagaggatttttattaagtttttggtagtgttttagttattaaatttagtttgttagttattaaatttgttttgttggtttttgaattatttttttgttggggttggttatgttatgttaggttttttatgtaggatggtagatggatagatgttgggattaagttatttttgggttgtgagatgtttgattttttgttggtgttttagaagatgttagttttttgtggtatgttttttatgtggtgtttggggattagtggtttttaaggggtttttttgttttagtgtggggagtggtttggttaaggttttagtgtttggttggagttaggtataggtttaggtgtattggttggaggttttttgtttatgggttttgtttgttttgtgtttttggtttttattgtgttttttgtgtttttgggagagattttaggggttttgagtttagtattggggttggggagtgggtggggaagagggtggggattagggtttttggttgtagaatagttaggttttaagtttttattttattttttttttattgggtgttttattttatattgattattttttgaagaaaattttttgaattggttttttattttggttgttttaggaagtttatttatttttttgttttaatgttttgtggttttagaaggatggtggaagttggaaattatgagttttatttataggtggttatatattgaagttgtggagatgttgtgggaaaggattttggttagtgtggttggtatagagggagtggtgttattggggtagatgggaattgtggttgtttttatgttggtttgggagagatgaggggttggatgaaaggatagtagattggttatttatttatttatttatttatttatttatagtgttttattgggtgttttggatgtgtaaggttttgtgggtagtgaatgtgatagattttagatagtaattggagggttatgtgtgtaagaattgagggatttaggttgggtgtggtgttttaagtttgtaattttagtattttgggaggtagaggtgggtggattatgaggttaggagattgagattattttggttaatatggtgaaattttgtttttattaaaaatataaaaaattagttgggtgtggtggtgggtgtttgtaattttagttatttaggaggttgaggtaggagaatggtgtgaatttgggaggtagagtttgtagtgagtttagatagtgttattgtattttagtttgggtgatagagtgagattttattttaaaaaaaataaaataaaataaaataaaataaaaattgaggaatttagtgtagatgagttattttgggaaaataagtgggagttttaggaatagtatggggaagggatggttttggtagggaggatttttgtgggtagttttgttggaagagttgaaaggtagttagagaggttgtgtgtggatggaagttgaagagtaggttaggggtgtgtgttttgttaataaagattttaagtatttattgattaggtataatattatgtgttttataaataaatattttatttgatttttagtatttttatgagatagatgttattattttattttatatgtaagaatattgaggtatagagtggttaagttatttgtttagggttatatagtatgttggtggtaggtaggattttggagttataggaatttggtatattttaggtgtaatggaaattagttatggttttatagagggaaattattagattagtaaattttatatatgttttttggtgttttgaggaggagggatttggataggggtagttaatggtggtggttgtgagatgtgttgggttaatattgatgagagtttgggatggatgagtggatttggagtaatggaaatggagggtttaggtttggtttttggagatttagttgtaatagttgttggttggagaggttgtttatttagatgggggatggggtgggaggtaggtgagatgagagttttagagtttagtttggggtatggttattgggtttaagatgtttttagatgttggggtttgatagtgatagtggttgtagatatttaggatttagtagagggtttggtatagtggggtttagggatatgtttgtgagttaggttggtatttaagtgtgaatttggataaagaaggtggtattgttggtattgaatgtttaggggttgggtgaagttagttagggagaggggtttttaaggtattaggattgattttgtgggtgagggtggaggaggagatggtagaggttgagagaatagttagagataggaggaaggttagtagagttatgtatagaagtttggagaagatttgaggaaaggaagggttgggtggttgttattttttgtagttaggaggtaagggtgatttttgtgtgttttattttttagaggattggtggttttatttggttagaattttaagtttagagatgtatttgagttttatgttatggtgtaggtagtaggagttatggagtaggtttgtggggttatggtttgtttgttgttttttggtgtttttattttgagtttaggggttgtttggatgttttgtgttgtatttttttaggtggtgttttagagaggatgaaagtggttattttaaggtgtgattaggtagtggtttatgtatattgtttttttttggggagagtttgggatggaagggtatgtgtgtgtttttgagattttttgaataggttttatgtatttatttatttattttattatttatttatttatttatttatttatttatttatgtatttatttatttatttatttatttatttatttgttaatttatttatttatttatttatttatttatttatttatttatttatagttatttatttatttatttatttatttatttatttatttatttatttatttatttatttgtttatttatttatttatttatttatttatttatttatttatttatttatttatgtatttatttatttatttatttatttatttatttatttatttatttatttatttatttatttatttatttatttatttatttatttatttatttatttatttatttatttatttatttatttgtttatttatttatttatttatttatttatttatttatttatttatttatttaattatttatttatttatttatttatttattatttgtttatttatttatttatttatttatgtatttatttatttatttatttatttatttatttgtttatttatttatttatttatttatttatttatttatttatttatttatttatttatttatttttttatttatttatttatttatttatttatttatttatttatttatttatttatttgtttatttatttatttatgtatttatttatttatttatttatttatttatttatttatttatttatttgtttatttatttatttatttatttatttatttatttatttatttatttatttatttatttatttatttatttatttatttatttattaatttatttatttatttatttatttatttatttatttatttagttatttatttatttgtttatttatttgttaatttatttatttatttgtttgtttatttatttatttatttatttatttatttgtttatttatttatttatttatttatttatttatatatttatatatttatttatttatttaattatttatttttatttttattttagaaagtatttgaagttgttggggtgtgtatttggaaaatgtgttataagtttttataggtttttttttggtttttttatttttttgattggttttttttttggatatgtaggattttgagtagtttttttgggaggtgggtgtagtttaggtaggttgtttgtaaagttaggattgagggagttatatttaaggtattgtgggtttttaaggtgatggtattgtgggtttattgtttttagatttttttaatttttaggtttttgagtaggaggatttttggggtagggtttggagatgggaagagaaaataattttagttttttaatttttgttagtttaggtgggtgttgtatggattgggggtatttggaatagttggtttttttattttttttttttatttttttagtttttttggttataattagatagttgtgtgtgatgttttttttttttttgaaggggttatttagttaggtttttatttatggtttaggaatgtgtttttttttgtttgttttttatttttaagtaggttgtgtttttagttttttgttgtttttgaagggtttgggtatggggtagtttttgtagtatttttagggtttgagttgatttgtatagtagaagggaattgggggaaagttttttttttatttagtatttggtagggggttattttgttgtattttagagatttttgtttaagttttgttattttagatgattttataagttgggggaggtggagttttagtttttatagtttttgttgttgttttattgttgagttttgttgtgtatttgttgataggtttgttgatagtagaaggggttggagagagggaagttttgggttttgttttttttaatttttgtttaggggatatttttgataagaggaaattttagtttgtgatagatggttagtgtttatttatttatgggggaatttttttttttttttgtaagtttgtagatttgttaggaattaaaggaatttttggttgataggttattgtggatatggttggagggttggtatgggttggattttggggttgttttgaggtaggggttgtttttgttggaaggttttttggggtggggaaggtattagggttattttttgattttttttttgtagtggatttattttagagtttgagataaggtaagggggtagtagaaaatagaatataaaatagttttttttattatatattgtattagaagttagaggatttatttttggtttgttttttttgtagtttaagttttgagagtggttttttaggaagtgaatggtgatggtttgtaggttagagtttgttttggtttaagattgatgttttaataggttgtggagtttgggtgaaaaaatttaggttagggaggtggtgggttgtaaatgaaagaatagaggagggttttttttagaaagtggtgggtggtgtgaggagtttttggattttgtttaaatttgattttattgattggggttaattgaaattgtgttggtagaaaggtaaaattgtttgagatttttttttttataatagaggagaggtttgtttgaaagggtttggtgagggaaaagttggaggaattttggttggtagtaaaagtggggatttttgttttttgttttgggggtgttttggtttttgaatgaatgaaagaggaggttggatggagatagatttatattatttgttttttttaggttttgtaaaggagtatatagggtttttgttggtttttttattttgttagttattaagaaggagaaaatattaataggggaattgtaaagttgtagttttgtttaagttttatagtggaaattggaaagagttttagtttggagaaaaatgtagttttttgtttttgtaaatttgtgtttttttttgggaggttagagttattgtgtttgatttttaagtagggttttagagtgttttaggaggggaaggtagagttttagatttttggtattttaggttttaattaggttttgaggagatgttttttgttttatataaagtgtgaagtgtaatttgatttggagttagttaataaattagatgagttgtgtgtattttaaaaatttagtttttgattttttatttatatatatttgtataatttggttatttatatttagtgtttttatttttagaagagaataggaagtttttagtgatatttatggagtgtttgtagtagtttgggtaggttagtaggaatataatgtagtgaaaagtagagttgagatgggaaaatattttgtttttagagttttttagggatgatattttttattgtttttgtttatttgttttggagtttattttgtaaatagtaatttgtttttatttgagagtttttttttgttggagtttagggatggagagtagttggttttagttttttttttttatttttttgttttttagatttattttttattttgaataattgtttttaatttgtttttttttttttttagttgtagaatttagaattttgtgtgtgtggttaaaagtttagagagtgttgtaggtaatgttgagataattttattaaattttgtaagtttttattatattaagtttgtttgttttttttaatttttattttattttattttattttatagggatggggttttgttatgttgtttaggttggttttgaatttttgggtttaaatgatttttttgttttggttttttagagtgttaagttatttttttaattgggatttatgggtttagggattttttgatgaattgtttaaaatatgtgtgtgtttgtttgtttgtttttaatgtatatttttttagggagagtttttattttttattagaggtttgtggtatatatatgttttgtattattgtattagattgtgaattttttatatgttaaagattgttttaaatttgtttggaagttttggttaataaatatttaaataaatgaattttaaatttttatgtgttattattgtttttattttgattatttttaagtttgtagtgttatttttttgttattgtgaagtagatatttaataaatatttgttaaatgaattaatgttatggttttggtttattaggattttaggattattgtttattattattgtttatagtttttttattattttgttttagagtagttttttttttgaggtttgtttatttttgtatgtgtgtttagtttttagttttgttgttttattatttttttttttttatttgtattttttgaattgttaatagttaataatagtttttttttttatttatttatttatatttgaagtgagaagttattattgaggtttttgtggattttgttagtttaatttggggtggttttttggaggtggagtttttagatgagggatggatattttggtgtttgttgggtagatttatttgggagttttggtaggggttttagggtagttttgtttttttattttggttgtgggatttttggtgtattagggttttttaagtaagtatttgtgttttgggagagttataggtaggtttgagagggtttttggaatttgggatttttagtttggtttagtagttggtattattattttttttgtaagggaagttatggaaattaagatgttaatgtgttttgataggtttggggtggttttaagttttgggaagagttttggtaattttttttggttggtgggtagaatttttttttggtagtttagggttttgtttttagttttttgggggagagtaattgagggaggagttggaggttaaggttttagtgttgagttgtttgtattgtagttgtattttttgggttttggttgtaggaattttatatttttttagtttttttatggtttttgaagatttggtttggggagggggttagtagtttggggtttatttatttggttttaaattttggttttattgtttatttgttttgtgatttttataattgataaaagtttttttggttttggtttttttatttgtgaaatgggataataatagtggttattttataggattgtgtgatgatttattagttataatagtttttgagtagtgtttagagtaatatttggggtttggtgtagtggtttatgtttataattttagtattttgggaggttaaggtgggaggattgtttgaggttaggagtttgaaattagtttgattaatattagtgagatttattttttaaaaaaaaaaattagagtaatgtttggtatagagagtttttagtaaattttggttgttgtgatgagttttgtttttttatttgtttatttatttattagattttttgttggggtttgttgtgagttttatgttgttttgaagaaagttgggttggggtgagtgtgatggatgaggtgtttggttttataaattttgtgtgggggggttgtggtgagaggaaattgtatatattattatttagttattattgtggggagattgtttggatgtagagagtaggttttgtgtgggagtggggagggtaagttttggttgtgaggtagggtttttttaggatttagtagggatttgaaggattttgtaggtatttagggagataggagaggaggagggagtagttttggttggatattgtttttttagtattgtttgtattagggatttatttagttttaagaagtttttttgtgggggatagggagtatttgttagtttataggatttgaagtgtttttatgggtttaagtttttgggaaggtttgtaggtggttgtagggttgttgtaggggtgttggttttagggtttggatttaggggagtttgtagagggagggtagttggaggttgttttagtgtgtattgttatgaggtaaagtaaggagattgttgggtttatgttgggttggggtggatggaggtaaggaagtttttgttggggtaagggtattagttgtagatgttggtagtttttttttggatatgggtttggaaggttgatagggtgtggtgagtgttattggtttttttgttgtggtttggttagtggttttataggtttttgtgggtaggaggaggatgattttgtattttgtttggttattattggtagtgatagataaggtgtgtggggatgtggttattttggtttgtgttttgagagttaggtgtgggttgggtttggggaagataggggaatggtattgatttgattttgagtattttgttttggggtgtaggtttggttgttatttttttggagttgggaatggtattgggtggtggtttagggttttttgttttagtggtattatttttgtatttggttagtaaggttgatgggatttgtgtggatatttttgggatgtagattaggtagtatgatatatagggaggggtaggtagagaagggtggtttttgggttttggtttttaagttaggttttgtaagtttgttgtgttaagtttttttttggtattaggttaggtgggttagggttagttttggggttgtgatgagtgtgagtgtttttaaagtgtgttatgtttaatagttgttttttttttgggtattgttttttagttagatattttatagtttttgttttagttatagatagtaatttgatttttttatttttggtaggttttggggttggggtaagaatttgttattaagtgtagatgtttttagagggtgttggtttagggttgtgtggattatagtttttttatttttgttttagatttatttgtaattttggagaaaagatggtttagtggatgtttgtggggaggagggagttggtttttaggatgagtagatttgggggtagtttttattatgggattggtgatttattgttattagtgttagtgaatggtagaggggttttggtataaggtttgggtttagaatgggaatttgtagagaaattgttaaggttttttgttatttgatatttttgtttggttgttattttagaaatatttttgttgtaagaagatgggggagtttgtttggggtatggtttggtgatattaatttgagaattttaggtttaagtgttggtttttgggttttagttgttttttgagttgtaaagttggtttttgggtatttgtggaaaatattggattttttattttattttattttatattttgggatatatgtgtagaatgtgtaggtttgttatataggaatataagtgttatagtggtttgttgtatttattggattttttaatttagttttattagaaatgattgttttttttttttttttttgttttttttttttttttttttttttttttttttttttttgtttttttttttttttttttttttttttttttttttttttttttgtttttatggggatataatttttatattatattatttgttgatttagaaagtatagttgagtggtatttttttataattttttataagtattatttttaattttagaatgttttttttattttaaaaggaaatgttatttttggtatatagttatttttttttttttagtttttggaaattattaatttgtgttttgtttttatagatgtatttattttgaatatatgattagaattttaaaagatgtgattttttgtgtttggttttttgtagttggaatgtttttagagtttatttgtgttggtgtatgtttgtgtttttttatggttgagaaatagtttgttgtgttgatttagtatgttgggtttttttatgtatttgttggtggatgtgttagttatttttggagttgggtgtgttgtgttatttatgggttgtattaggagttggggatattattgagtaagttatagttttgggtatttaggagtttgtagagtaggagttgggagggaggttaggaggtgtatggtttgtttgttaggttggagagatttgtaaaaagttattttgagttagaaattagagtttgaggtttttgatttttagttgtggagttgggagggaagttttgtattttgttttgattgtggggtgatgtgttagttattgtttaaattagaatttttttgagagttgatgtgggtattgttgataattagtttggatatttgaaagaatggaaagtagggatttagatagatttttgtataattgtgtttgtagtagggtgaggtttggaggtgtgatggggattttaatggggtagttgttgttttgttggagtttatggtttttggggggggttataggtgttaattgtatattatataagtaggagtgtgaaattttagggttgttaaatttagtgagggttttgtgttggtttggttatttatagtggtattttaggaaaaaaaattattttatggattttagtttttttattagtaaagagtaggttggattggaattttgtattatttagtatagttgttatttatgaaatgtggttatttaaatttaaataaaaatagaaattttgttttttagttggattagtttagtgttaagtgtttagaagttatttgtgaatatattgtggtaattttttaaaaaatgaaaattagaattattgtagtattttataattttatttttgggtgtggatttaaaagaatgtatagtattttaaagagttagagatatttgtatatttatatttatagtggttttgtttatagtagttagtgggtagaaataatttgaatgtttgtggttaaatgaatggagaaattaaaggtgggataggttgggtgtggtggtttatgtttgtaattttagtattttgggaggttgaggtgggtggattatttgaggttataagtttaagattagtttgattagtatggagaaattttgtttttattaaaataaaattagttgggtatggtggtgggtgtttgtaattttagttatttgagaggttgaggtaggagaattgtttgaatttggggaggtagaggttttggtgagttgagattgtgttattgtattttagtttgggtaataagagtaaaattttgtttaaaaaaaaaaaaaaaaagggtggaatatataaggaatttgatttagttgtaaagaggaagttaggatatttgtaatagtaagggtgaattttttgggtattatgttaagtgaaataatttggttataaaaggataattttgtaggattttatttatattaggtttgtagagtagttagatttagaaaaatagtagaatggaggttgttagaggtttgggggatggggttggggagttgtttaatgaggatagtttgttttataagatgaaaaagttttggagatttgttatataataatgtgaatgtatttaatattattggattgtatattttaaaatagtgattgtggtaaatgttatgataattaaaaggaaaagttatgtggttagtggttattatgttgagtagtgtaggttttggatggtgttgtggttatagataatggagtgggtgatttttattattgtttttagttgtttgagtattatggtgttttggggttaggatgaaagtgtttttgggtatgggggtttttgttttttttatttgggagttttgaaggtagattttaaagtttatttggttaggtaggagagtgaggtgggtttttgtattgttttttgtgtgtgtgtttgtttgtgggttagttggggtttgtaaggttgttttttgagggaggggttgtaggaatggtttttatttgtgtagaaggtaagttattgttttatgttaatggtaaagatggggtttggttgtgttgtattattattttttaagtggggtttttggtgggtaggatgtttggtttgatttgagtttttgtagtgagtgttggtgtttgtggagggatttagttgtagttgagttggttttttttttgttttgggttttaggggtgttgggggtgagaaaggagagtttagggggtagtgtttttttttaggttttgttggggagggttgagggatgttggggggaggtgggggtgggtaggggttggttttagttttaggtaaaatggtttttagatttataggtagatggaagtgatttttggttatgtgggtggggattgaattgttgttttgtaaggtaaggttttatgtttggttttaggaagtggttttaaagttatatggtttatggttagatgtagggttgtgtttttgtttatttaaaggttttggaagtttaggggagagtatttttgaagggggagtaggagtaggagtaaagttttgaaggtttttaggttgtgtggtttgggtgggggttatgtgggggtatagagagaggagttttggtttttaggtttgtttgtgggtattgtttttagtagtggagatgtgtggatttttttttggtattttttaataaggaattatattgtttttttgtttttttaattttataagataggaatttttgtgttttgtggaggttgagaagatggggaggtgtttgtgaggataaattagtttttagtttttggtttttagagttttttttttttttatttttgatgttttaggtttggggagtttttttttgatattttttgattgttttagtgaaataggttgagagggatggtttgaattggttggggatgtaggttgtagttagggggtttagtgggtattttttgagtttggtttttgttttgtaagtggaagggtagttgaattgaagttttttattgttttttttggtttggaagtttgttttttattttttgggtagagtgaggagtgggtgtgggttgggagggttgttttttgtttgggagggttgtttatttgtttgttatgggggatgagttttttgtagttttttgtgttgtggttttggtttttatgttggttttatttttttgtggttgtttttgttgggtgtttattggttttagggaaaagttattttttttttggaggattggtgggaggggttttgtttgggagtgtgttgtgtggtttttgttttagtgtaggatgtttgaggttagattttttttgggaggtaggatggggtaaaagtttttttgtaggtagagtagggtttggatgggtttaagtagggatgggggtatagaatagtagttgtttagtttgtgtgggagttgagggttattaagggtagttttagtttgtggggattagtagaggtattatttttgtgattagtgagttgtttgtatttgtatgtgtatgtattagtgagtgtggtgagtttgaggtgtgttgggatttggtttgtgtattagttagttttgatgggaattagttttattttgggtatttttggaattttattgtgtgggagtatttgggtttttagtaggtgttttttgggtgtttgtttttagttttaggtttttgatttgtgtgtggtgttttaatagtagttaggagtagggttattgaagggatttatagatagaagaggttttagtgattttgggaagtttagttttatgtgttttatatatttaagagtaaaatttggttttggtttgtgggtgtgtagtttgtgggtgttggttaggtatataagatggttgtttgggttagtttagggggaggtagatgtggtgtaggggttttttttttttatgagtttaggaatagttttgtatttaggtatttgttttgtatttagtattttttttttttttaggattgttggtttgttttatgggattgaatatataattttatggggattgatgttggttttattttttttttttataagattatttatggggatgtgggaggtggggatatatgttggttttatttttgttttttataagattattttttttgtgttttggtttgtggattggtttttaaggtttttgagtggtagtaggtggtatagtttatttgagtagaggtgaaggagagggttaggtttatttgggtggtttgaggtagtgtggagggttaggagaggagagtattttttatttttgtttgagtagttttttagggtatggagataggagtttagggttagttttgttttggagtgtagggggtttttagtttggtatagtttttagaagaggagatgaaaaagtttggttttgggagtttggggatggagttttgttggggaggtagtgtggttgtaggatggtagttttttagaggatattatggttagggatatttatttgggggaatttttaggggttgtttgggtaagttgtttagtttttttgagttttagtgttttagtttttttatttaaggatgggtgtgataattatttggtaggtgtttgtgtgtgagtttttgttttgttttaatttttttgttgttttttttttagttattgaggtggtttttagttgtgttggtgatatggttgatatttttagagatgttgggtttaagtaggtgtttgtattatggaatgagaaggttttggtggattttggttatgtggggattgattttattttggagtagatgtgttggaaggttatgaagtagggttttgagtttaatattatggtggttggtgagtttttattttgtatgttatttaattaatgttggaaattagttttagtttttagggtggtttataagtttttgggtttggtttttttttttgtaaaatggggtagtaattttgattttaaggatggattgttagtgatattgtgtgtgtatgtatgtgtttgggaggagtttatagtttttagtggttttttagaggggtttgttttgtatatttagggtttttgagatgattttggggagtttaggttggtttggagtaggttttgatgagtggttgttgtttttgagtaatgatgttagtttgtgtagagggttttgtggtagttgtttttttattgttgttttagtttggttttttaggttttttattgtattttattgtattttggttagaggttttttagtagtttagttttagttttgttttggaattggggttttgtggtttttatattttttggtggttttggagagttggaggttattatgggaggttgttgattagtatgatttgggtagggtgagggggttaggttggagtttatagtgggttgtttgttgtttttaaagttttttaggttttatttaaattttatagggattttgtgaagggggtgttttgttttttaggtagaagtgaggtttagggaaggttgttaaggttttttagtttatagggtagagaattgtagttattgttttgatttttagaattgtgttttgtttattttatggggtttagggaggggtttggggaagtgtttttgttaggttatattttaaataaaggtgagtttgtggggtttttgtaaggtgtttgggtattttttaggttgggtttgtttttttgatttttgttagttgtgtatgttttttttgtttagttttgtggatgtaaatttatatttgttagtttgatatttttttttttttttttgtattgatttgggttttggtttttttggggttttggtgttttttttgttttttgtagttttatgggatttggttgtttatggttttgttgtgtttatagttgtttggaagttggtagtttgttttaagggagggtggaggtgtggggtttttttttatggtttttattttgttttgtttgttgtgggggatgtgtttgtattttgaggatttagggttgttttttgggaagatggttggagagaaagagaggggagaggtttaaaggtagtggttaggttgggatttatttttgtgggttatggaggggttgttttgttttttagttagggatagggtgagaaggatttgggaatttttgtgttttagttatggtataggtttttttttggagttttggttttaaggagagggagaggtagtttagtagtttttgttttttgtggttgttattgtgatagttttgttttttgggaatggtgtgtaggaggttattttatttgtttgggtttttttgtttttttaattttgagaagaatagtggttttgattttttataaaattatttttttttagggatgttgagtgaggaataagatgtggggtagttttgtttttttttttttttttttttatggtagttgtgtttatttgtagaggtgtaggtaaggtggaggggtatttgtttggaggtttatagattttggggagaattttagttttgttttaatttagtggggtgaggtttgtgtgtttttttttgggttttttttttgtgagttttagtttttttgtttataaaatgggattattttataaagtgagattaagtgagttaggttttgggtagggtttttaataggttgtggttgtttgagaatttgtagtagtggtgatggtggttgtggtgatgaggatgatgggggtggtaatgatggtgatgatgatggggtgatggtgttagtggagatgatggggatgatggtgatggtggtggtgatagtggtgggatggtagtggtgatgtgggtgatggtgattgtgatggtggtggtggtggtgatggaggtgatggtgatagtgattatgagggtgatggggatggtggtggtggtgatggtgatagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggtgatggtggttgtgatggtggtgatgtgggtggtggtgattgtgatggttgtgattgtgatggtggtggtggtgatggtgatgatggtggtgattgtgatggtggtgatgggagtgatgttggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgttggtgttgatgattgtgatgatagtggtggtggtgatgagggtgatggaagtggtgatgatggtgggagtgatgggatgatggtaatagtagtgatggtattgtgatgatggtgttgatggggatggtggtgatgataagggtgatgatgatggtgatgataataataaaagtaataataataaagggatatattttgtagtattttagttggtattttttagatttaaggtgttgtggttggaatattgatataatttttgatttgaggttggttaggatatagatttggtggatagagagagatggatgaggagtgtttgtttttgggttattaaatagtttaggttagggatttttagtattagtttttgtttttttaggagtttatattttttttagaaaggtgttattaaagttagaatattagtgtaatttagggtgttttttgtgttgtgtttttttgagatagggttttattgttgtttaggttggagtgtagtggtatggttttgatttattgtagtttttatattttgggtttaagtgatttttgtgttttaggtatgtgttattatatttggttaatttttgtgttttttggtagagatagggttttattatgttggttaagttggttttgaatttttgattttaagtaatttattttttttagttttttaaagtgttgggattataggtgtgagttattttgtttggttgatttttgtttttttaaaagatagggtttttgttattttggagtggtaatgattttagtttattgtagttttgtatttttgggtttgagtaatttttttattttagttttttgtgtagttgggattataggtgtttgttattatatttagttaatgtttatattttgatgtagagatagggtttttttgtgttgtttaggttggttttgaatttttgggtttaagtaatttttttgttttagttttttaaagtgttgggattataggtatgagttattatatttggtttagggtattttttttggtgtgttgttagtgtagtttaaggtagttttgtgtagggtaaagtaatggggttttgagtttggaggggtgtgtgtgtgtgtgtgtgtgtgtgtgtgtgtgtgtgtgtatgtgtgtgtgtgttatatgtgatttgtttgtgtgtgttgtgagagttgtgtgtgaggtatgtgtaagaggtatgtttgaggtgagttgtgtgtgtgttgtgagttgtgtatgtgaagtgtgtgtgttgtgaggtgtgtgtatgaggtgtatgtgagttgtgtgtgttgtgttgtatatgaatgttatttttttatttttgtttgttttagttatttgtggattggttgtttgtatatatggttattgttttttgagtggtattattttgtaggttagtgttttttagtatatggttttatagattttatgggatatgtgtgagtttgtttgatgtttatattagttttatgggggaaggattgtttattttattttgtagattaggaaattgagatatggtgaggttaggtgatttgtttaggttttggttggttagggaggagtagtttgaatatttgggttttggttgtaattattttggtgaattgtaggaattttggttatttggtgtattttgggtagttttgggtttttttgttagtttggtttttgttttgtttaaaatttgagttattaggagattttttgtttagaaagtataaggggtataagagatgttgatttttttaggtttggtttattttttaggagaggattgtggtttgggttgtgttggtattagagtttggttgtgtgggtttatatagttattggatatttggtttgagggtgaagtttttgggggttgtttggtagggatattgttgggaggtagtttaggtattgttgaattttagattggagagttttgtgtttgggtgggaggggttttatgtgtagattttgttggtttttttggagagatttttgattggttttttattttttttttagggtagagtggtttgggtaaatttattttaattaatattttttttaaatttaaaattagttggaagttggtgtagtttattttagaggagtgtatttttaagattattgagattaagtttattatgtatggttagtggttgggagtgggttgggggtgtaggatgtttttgtttttttggagtataggggttgggggttaagattattatatatagttagtggttaggggtgggttgggggtgtaggatttttttgtttttttggagtatagagtggggggttaagattattatatatagttagtggttgggagtgggttggggatgtaggatgtttttgtttttttggagtataggggttgggggttaagattattatatatggttagtggttggggatgggttggggatgtgggatatttatgtttttttggagtattggtgtggtgtgagggtgtttgagttaggtaattttaggtttttaagatggggatttgttgtgtttattatttttagtatgttgagtatgttggggttttggttgtgatgggttagtgttttggatttttgtgggttttgttatattgagttttttatagataattgagttttttattaaaagtttgataggtaaggggtttttaggggaattgttattggtttgtgttggagttggttgaggaaggttattaattttttggtgtttttttggttgttattgttgtttatttggggttgttttggggttagttaggtgtggggtgtttgtgagggttttttgttttttttttgattttgtgtttgtggttttgtgtagatattgaggagaaaggtgtttggatgaagttgatagtgattgatatattagggtttggggattatattaataatgagaattggtgaggtttttttagggggaggagtattagtgggggttttagggttttttggattttatttagagttagttttagaggttttttggtttgtgggggtgtagggtttattttttgggatttgatatgttgttaaagttgtatgttttaggggtttgaaaattttggattaaagtagaattatttggggaattttgttgtttttaatttattatttgaggttagtttggggaggttggtttgggaggttgagggtaaggttgtggtatttttgtttagtaagttagattttttagggtatgtattttattggaaggtggggtgttgggttttgagttttgggaatgtatgatttgtttggggagggtattttatgtgtttgttgatttgtttttattttttatgtagttggtagtttattatgaagtttattaatgattagtatgagaaatatttgtaggaggaggttaatattaattgtaagaagtgtattttggatatttgtgtttattgttgtttttattttatttttgttattggttatttgtatgtttttgtagtgttggtgtttttatgttgggtgttttgggttttttttgttttttgggattgtaagatggtgttgtttgttttgttgttgggtgtagaggggttgagttaggggttatggttgttagttatgaagttgggggtgtgttatgtttgtatttttaaagttttatattgatttttatgtaagtgttttgtttagtttttattttttagttgtgttttggggagttgagggttaggtaggttttgggttgttttggagtttggtggtttgtgttttgtttttttaggttaggttttggtaggtggagtgggagtttttagttaagtatttgtagtggtgattgatttttttatttgggttttgttttatgggattttttagagggtttggtgtgtttttagatgggaagtatagagattagtgttggttttttttagggttggatggggttgttgttggtgttggtgagagttttttttttttgttggttttgtttgtatttgatgttgtttttagagattagtaagggtgggaggttgtatgtattttggtaggtggattttttatggttttatggattttttgtttttagttttttgtgtattttttgttagatatttgtggtttattttgagttagggttgggaggaggaggattagaggttagtaggagtggttggtggaggtagttgtgggtggtttgtttgtatgggtgggtggagaaggttttttgtatttgttgttttagatgtatttttttgggtggaggaagtttaggggtttggggaaattatattttgtgggtattaggtgtaggaaggagtttggttggtgggtagtgggttttatttagagtttgtgggaaaatttaagttggagtttttgagtttattttttggtattattttttgtgggttagtaggagttaggggtagggggttagtttgttgtttatgggttttttttgaattgaatatttgtttttttaggtagaatggtttatttgtggttttgtggtagttgttttagttgttttaagttttgttttagttgaggttgatggtaggaggtagaagttttttttgatgttagttgggtaagttgagggtgggtgggtggtttgtggtatttttgttattttttagtattgattttttggttgggattttagttaggtatgttgtttggttttgtttaaggtgtttagttttatggggtaggggtgggttttggttatttttgtttaaatttttgtttggagtgggtttttttttagttatgtgtgtgattgatttatttttattgtgggaaaagtttggttttagaattggggaagatggtgttttagttttagggttttgttagtttttgttatttatagttttttttatattagattttaggtttattggggttaagtaggtaaggggagtagtttgtttggtgtaggggagtagtttgtttggtgtaggggtattgtatattggtgttagtttttattttttttgtttttttttttttagttaaagttttatagtaagatggttgttgagttaatgatagtttttttgtgtggatatgtaggggtgtggttgggattttagaatttatggatgagggtgtttggagttggttttggtttgtttggtttgtgtagtggtgttatttgtgtttgggatatatttgtgttttttttttgttttatatttatagtgtggttgatttggtttggggttttgtttttgttagtagggatttttgtgagttttgagttagtatttgagagtgttgatatttgtttgggggtgggtgtttttttattgttttgtttttttagatgagttttatgtatatttttttgttttagttttaggtttttggatattgagtttatgaaatgtttgagtaaggtggttaatattgtttttgttattgttaaggtggatatatttattttggaggagagggtttattttaaatagtgggtagggttttatttttatttgttttagtttttttgtgtaatttggagatgttgtaggtttggtaggggttattttgtttaaaggagttatattgttagggagattgaattgttggttattttttttagtgggtggttggtttggtggtttttggtttaggtggttgttgggggttgtttttgagatggtttttttagtttttttatattttaaaagtagttttgtgggagtgttaattttttagtagagtttttgaggggggttttggagaagatttggattaggtagatggtgaattttttttttagggagtgaggttgagtaggggttgtgtgatatggtttattttgttttatgttttttttttttttttttgagaaagggtttggtttagttgttaaggttgtaatgtagtggtataattatggtttattgtagtttttattttttaggtttagtttttgagtagttggaattatagatgtatattattatgtttggttaatttttgtatttttagtagagatgaggttttgttatgttgtttaggttggtttttaatttttgggtttaagggatttttttgttttagttttttaaagtgttggggttataggtatgagttattttattttgttttgtttggtttttattagatggaagagaagttgggttaggtgtggtggtttatgtttgtaattttagtattttgggaggttgaggtgggtagattatttgaggttaggagtttgaggttaatatgatgaaattttatttttattaaaaatataaaaatattagttgggtatggtggtgggtgtttgtagttttagttatttgggaggttgaggtaggagaattttttgaatttgggaggtggaggttttagtgagttgagattgagttattgtattttagtttgggtgatagagtgagattttattttaaaaaaaaaaaaaaaaaaaaaagttttaggagggatggtttttgttatttttttttttgttattgtttgaggtttttgttgtgggatagggaggggtatttaagtaagagggtagttttgggtttttttttttgatagggtagtatattagagttatatggggtgttttttaaaatgaaattgaggtgtttgggttgtggtattatatttgttttggtgggtgtgggtggggtttgtaatttattttgttttggggttaggtgttagggatttttttagtatgtgtaggggaagatagtttatataaagtgggtgtgtttgttggaggttatatatgggttgtggtttgtgtttgggtaggtgagtagttgtttattgggatgtttttgttgtatgtatttatgttgggttgttggtagggagttgagaggttattgtaggtggggtttttgttggaattggggattgtgatgagggttttttaggaagggttttaggaggggaggttttggtaattttgagtatttttttggggttgtgatgagtaggagaagagaggtgggaggtgtttaggatgatgattttaagtttttggggagttgtagtgttgtttaggatagtaggtgtatttgtagttgttttttttttttttaggaggtataggagttggaggtgattggtgttatagttttttagagtttgtttttgaatttgagtttggggtagtatatagtgtggaggttatgtggtaaatattagtgggtgggtagagtttgttatagggatgggtttatttttttttttttttattttagattattgtagatttgttgtttaatggtattgatgtgtatttttagaaggaatttgatgaggatttggaggattggttggtgaatgagaagttttgggtgagtggatttattaggatgttgtttttaggggatttttagtttttgttgaagggtgggttgggggtttggaggattttaagttatgaaattatatttttggggttagagggtattgagtttaggtgtttgtatttagtgttgttaggttgaggtttttgtttttgggggattttaggtttagggtagttttttttgggggtttaggggagggaattgtttttttgtatatgtgtaattaatattgtttgtttgttttttaggagatgattttatttgttgtggtgggtagtgattatgagtattaggttaatggtaagaggatttttgggaggaagattaagtggggtattattgaaggtatttgttgtaggtgttggggttttagatagatgggaagatagttttttttgttgatttagagtttgtgggttatgtttgagttagggatttgtggaattttatttattgttttgttttatttagagggaggggtttttttgtttttatttaatttttgggaaagtgagagggtaagtggtttgtgtagatgtttttattttagatttttttttgggtagggaaagatttagggagataggagttgggatgggggttgttaagttttggattttggtgtaggtttttttataggtatttgtgtggttttggataaattgtttaatttttttgggtttagaaaaggggtgggttgtagttttgtgagttagatggatttttggttttttattttgttgaagtttttgggatttttatattttagttttttgagtggttgttgtaattaattagtataaatgaggggatttaaaataatataaatgtatttttatagttttagaggttagaggtttgaaattaggggttgtttttttttgaggttttgaggattagttttatttatgtttttttttttttggtggtgtttggtatttttagttgtattgtaaaggtattatatgttttaatttttgttttattgttatagggtttttttttttgtgtttttgttttgttttttttttttttttttttttttttttttttttgtttgagatggagttttgttttgttatttaggttggagtgtagtgttgtaattttagtttattgtaatttttgttttttgggtttaagtaatttttttgttttagttttttgagtatttgggattatagttatgtattatttatttgatttaatttttgtatttttagtagagataggattttgttatgttggttaggttggttttaaatttttgattttaggtgatttgtttattttgtttggttttttaaagtgttgggattataggaatgagttattgagtttgtttttttttttttttgtttttggataaggatgtttgtttttggatttagggtttattttaagtggatgattttatttggagatttttaatgaatttataaagaaagatgttttttaagtaaggttataattatgggttttaaggtttggattttgattatgtttttgaatggatgggagtttttggggggttatagtttaatttatttttggtggtgatattttgggagggatgggtttgaatgttttttttttttttttttttttgtttttttattttttattagaatggaagaggggaaggtgtagagggaaatgtagtaggaaaagttattttgttttgggagagtatttggttgaaaggtttagtagagtaggaagtataagttttttaattttttagggttttagtttttattatttataaagtgggtgtagtgtgttaagattttagtgagttgagagattgttttaaagattatagagttttttgggaagttgttgttttaaaaaaatggttataatgataattattaggaggtattagatatttttgtgttattggttagatatgggttattttgttttatgtttgaagttttttgtatttattttttttgtagagttgaagaggtgttgtgagtagaaaatttgttaagggatttagaatgggaggtggttttagaatttatagttttagttttgtattagatttttttgagatgggagtttatgtttggaggagggtgtggagaggtatatgggttttttttttgtttgtattttttttttattattatttttgttgggtttattttgtgggagttgtttagttgggtgtagtttgggtgttttttagtatttgtttgtggtgttaggttggtttgtttttttttggtttttttgtttgtagtttttttttttttttttgtttaaagagtttttgttgtttaggaaattttttatgaaaggtaggtttgggagagttagggatggatgggtttgggatgggttggtggttttgttatgggtgtgtttttgttgtattttggtggttaattttgagtattgtaggtggttggtgatagaaattgttaggaaatgtataagagagaggtttttgtatttttttgatttgtgtgttgttgagtattattggttttagttgaggaagagtttggaatttgttaggatagttgtgaggtggtggggtttattttttagtagttttatatgaggattttggaaatgtgtttttagtattgttgggtttttatattaggggttttatgagtttatagttgatttgatatttggattagtaagggttgtgttttgtttttgttttttatttggtgaatagtattttgaggtattttttttatttttagaaattattttaagtattgttaatagaaatgtggggtgtaattgattatgttatgaatttatttaatttttatgtttttgagaggtgggtgatgttattatttatattttatggatgaggaaattgagggaatgagagtaatttgtttgagttagggagtggtgattatatattttaattttagtttgagagttttattttttttgttggtttttgttgtttgttagtgttagatgagagtgttgttggttagtttgtaggaggttttagtgtggatattgttttatatagggttgtggtaggagggtttaggtaaaggtaattggtatagtattgagagtatttgagggttgggtaaggtggaggttttggttttgtttgttggtttattaagtaaaaattagatatttttaatttggggaaaagttatgtggttttgtgatggggtagtttggagttaggtgtatgggttttgtattttgttttagttttatgtattgtggagttgagatagatatagtttttgtgttttttatgttttattttttttttttttttttttttttttttttttttttttttttgagatgaagttttatttttttgtttaggttggagtgttgtggtgtgattttggtttattataatttttattttttgggttttagtgatttttttgttttagttttttgagtagttgggattataggtgtttggtattaggtttggttaatttttgtatttttaatagagatgagattttattatgttggttaggttggttttgaatttttgattttgtgatttatttattttagttttttaaagtgttgggattgtagatgtgagttgtggtgtttagtgtttatgttttatttttgtaagataatggggataataaaggaattataagagatatttgtaggtgtgtgaagatgaagtttattatatgggagggtattgggtgtttttatttgttttttttgtttggttttttatttttagtgatgttgtttattgttttttttgttaaaaggttttttgttatataatagttatatatgttaggtattgtgtgtttatataggagttatgaagtatagtaataaaatgattattttgagatggttattagtttgagtttgagggtatttgtgggtgtttgtggttttttgtttagtttttttgagaagtggttattgttttgagtttgggtttgtatgtattgtgtgaagtgtatatgtttttgagtaatgtttagtattgttgatttttgagtttgtgaatggttgtttatagtatgtagtttttgtgtgtgtttttgtgtgtgtgtgttttgagtgtatataaggtggatggggttgtgggggtaatattttgtgggttataggttttttttaaaattttagttttgatttttgttttattttatttttagtagtttagttttttgtttgtttttaggtttttgttgggatgttttgttttttttggttattttagtggtgtgggggtttattgttttggtttttttattgtggtttttttttatgtttttatttggtttggttattgtgttattttttattagttaggaattttttggagagtaggagttgagttgtttaggagtaggagttggtgttggttattttagtattttttagattgagggtagtgttaggtgttttatatttagttgtagagtaggtggtttttttgtttttttgtttatggggttgtttttagattttgtttttggtattagtatttttgggtagggggagagaggtggggtttgggtagagtttttttattgggatattaaagttttttttgtttttttttttagttgaaaatattatatattgtgagtttgtttatttgtgggatttttttattaggtgagagatagggtgtttgggtggggttgatggttttatttttaagagggttttatagtgggtgggggtagtgggtgtggggttgaagttttgggtagagtgggtgttttttgttatttgtttgttttgtttttgggaagattttggaagtttattttttgaaaaagaaaatttattgggaaatgaagtaggtagtgaagattttttttaatttttgtgaagttggttggatgggaaggttgagttttgatttattgtggtttggtttgttagagttgtttggtggttattaagggtttagtgaggttttatgtgtaggttttgttggtagtgtggggtgtttttagttttgattttattggtttttgatttttattttttttatttggttgaggtttttttttgttttttttgagtttaggtaaggaggggaagttttgatggagagggtgttgggtgggtggtttttggagtgtgggttttggtttgggtaggtttttttttagtaagtagttggtatggatgatgggaatgttattaagaggaggggtttttaggttggtgggggtaggggtggggggattttgggagttgttttgttattgtggggatattgggttttttaatttttttttagattattttttttgagttgtagaggaatgaaaatttgagtttaggattttttttttttggggataagggtaatttagttttttgttttaggttatttgtttgttataggttatagttttggaggttggtggttatttattgtttttattttgttagtattttggatattggtttggagtaataatgttttagttttgtttttttgagtttatgtattgtttttgggttttggatttagggttatagggtggatttagagggagatatatgtattggaatatgtgtgttttgattgagtttgggtttattagggggattgattttttttttaaaatgtgtattagatttggtttaatatggtgggtttgggggattttatggggagttaagtagttgggatggggagtgggggtgggggtaggtgggtttgagtttgaggtaggttgagtagggtttttgttttgttgtttttattttgttgtgtttattttattgatttgtttgttttttatttttataggatgtatatgtagaatattaaggatattattagtagtatttattttgaggtgtattgtgtgaagtgttttaatgagggtagtagtgttatggttaatggtatggaggagaaggagttagaagttttggagatgtagatgttattttgtttatttttgggattttgtttttaagttatttttgtttttttttaggtttttttattattttattttattttatatgattttttttatttgttattgttttttatttttttgatatgttgttaggaaataagggaaggggtttttttttgagtgagttagtgatgaggttgtggtttttttgaggttgtggggaggttgtattggagttataggtaggggtgagagtatttattgaattgatatgattttttgtttttaggtttggttttttgagggtttagaagagtagttttggtgtgtagattatttgtttgtgtggggtttttagtgttggaggttttggggtgggggttaggttttgtatttgtagaggagtttagtgggttgtatgtttttttttatttttattggttttgttttttggagtgtgttagagtttaggggagaatgtagtttattaggagtatttggattttttgtttgttatatggtgtggttattatttagtttttatttttgttttgtttttaagggtagaaaattttagggttttttgttattgattgtttagttattttaagttttttggtagttgttttttttggagtagaaagtgtttttattttagttatttgtagattgtttggttagatgtggggataggttggaatgagggaggtgtttttatttttttgttattttttttttatgttatttttgtttttattgggttgtaggtgttgttgatgtgttgggatttgattgaggataaaaaggaaggagagatgatttttatttttttattttttagttttgaaaaggtttaagtaagtgagtttggtggaggagttgagggagggagttatggaaggtgttagaaggaaggttggtgggggtatgtgtgggttgtggtttgggttggttagagtggtgtgagttgtttggtgtttgttttgtttaagtgattagggaagtgtgtgtgtgtttatgtgtatgtgtgtttgtttgtttgtttagtgtttgggtttggtttaagattgggttgtagttatattaatgtttagttagttatttttgttatttattttttttggtttaggttttgttgattttttgagttggggaggtgggaggttaggtgagtttgattttgttgatttatttgtgtttgggtttttttttttagagtttatggtaatgaatttttagaaaggagagaatgggtgttaggggtgtatagtttatagttgaagagtaaggttttgtggtagtatggtttggttttttattttttgtttttatgaggggatttatgggggttgtttttgtagggtatagatgattaaagtttttttttgttttttgttatttgttttgtttttggggagaaagaggggtttgatgagattttatttaggtgtatatattattaggtgtatttgtaggtattgggttggttgtttgtagttaggagaaggttagtgagaaggagtgtatgagtgtgagtgtgtgtgtatggaagttggggtattgggtgtttgattttttttttatttaagagaggaaggattttttattatttttattggtgagatagtttattttgttaatttgttatgtttttgttaaaattaagattttgaaggaaatgagtggttagtgttagggtttaggttatgtggtttgtttagttttaatgttatttggtggtggggtggggtgggggtgggtagtagtattttagttttgagatgttttattttttttttttgtaattagattttgaaaaattgtttgttttattaggttttgttttttaatggttttttgttatgtgttttttgagaaatttgtttttttgtataaatgataaagtgttgaaaatgtattttttgaaataaatgttttaaatgtagaaattta

SEQ ID NO: 11 - DNA, 219909 bp, Artificial Sequence
  source 1..219909: /mol_type="DNA" /note="chemically treated genomic DNA (Homo sapiens)" /organism="Artificial Sequence"
tgggtttttgtatttgaaatatttattttaggaaatatatttttaatattttgttatttatataaaaagataaattttttgggaggtatgtagtaaaaggttattgaggaatagagtttgatgaaatgaataattttttaaagtttggttatagagaaggaaagtgaagtattttaaggttgggatgttgttgtttatttttattttattttgttattaagtgatattgaggttgggtaggttatatggtttgggttttggtgttggttatttattttttttaaaattttggttttggtaaaaatatggtaagttggtaaagtaaattgttttattagtgggggtggtgaggggtttttttttttttgggtggggagggagttagatgtttagtgttttaatttttatgtatatatatttatatttatatatttttttttgttgatttttttttggttgtaagtagttagtttggtgtttgtagatgtatttggtgatgtgtgtatttgagtggagttttattaggtttttttttttttttaggagtaagataggtaataggaagtaggaagggattttggttatttgtgttttgtaaagatagtttttatgggtttttttgtggggatagagggtgaggggttgggttgtgttgttatgaaattttgttttttagttgtggattgtgtatttttgatgtttgtttttttttttttaggggtttgttattatgggttttgaggggaggggtttaggtatgggtagattaatagagttaggtttgtttggttttttatttttttagtttagagagttagtaaggtttgggttaggaagggtgagtggtaggggtggttggttgggtattaatgtaattatagtttagttttgggttaaatttagatattagatagatagatggatatgtatatatatggatatatatatatttttttggttatttgggtagggtaggtgttgggtagtttatgttattttgattagtttaagttatggtttatatgtgtttttgttaattttttttttggtattttttatggtttttttttttagtttttttattagatttatttgtttagatttttttaaaattgggggatgagggggtaggggttattttttttttttttttatttttaattagattttagtgtattagtagtatttgtagtttggtgggggtgggggtggtgtgagagggggatggtagggagatgaagatgttttttttattttagtttgtttttgtatttggttaagtagtttgtggatggttgagataaaggtattttttgttttaggaggggtagttgttagggggtttggagtggttgggtagttggtggtaggggattttggagttttttatttttaggagtagggtaggggtaggggttgagtgatggttatattatgtggtgggtagggggtttaggtgtttttggtgggttgtatttttttttgggttttgatatattttaggggatagggttgatggggatggaggggagtgtgtagtttattgggtttttttgtaagtgtgaggtttggtttttattttaaggtttttggtattgagaattttatatagatggatgatttgtatattgaagttgtttttttgagtttttggggagttaggtttggggatagagggttatgttaatttagtgggtgtttttatttttgtttgtggttttagtgtagtttttttataattttggggaggttgtggttttattattgatttatttggagggaggtttttttttttgttttttggtagtatgttgaaggggtggggaatgatgataaatggagaaaattatataaaataaaatggggtggtgggagggtttggggggggatggaaatgatttgggggtaggattttgggggtgggtagggtggtgtttatatttttggggtttttggtttttttttttttatgttgttggttatggtgttgttgtttttgttgaggtgttttatatggtatgttttgaagtggatgttgttggtgatgtttttgatgttttgtatgtgtgttttgtgggggtggggggtgggtgggttagtgaggtgggtgtagtggggtgggggtagtggggtaggggttttgtttggtttgttttggatttaggtttgtttgtttttatttttattttttattttgattgtttggttttttatggggttttttaggtttattatgttggattagatttggtatatgttttgggggaagggttagtttttttggtaagtttagatttggttagaatatatatattttagtgtatgtgtttttttttgggtttattttatggttttgggtttagggtttagggatagtgtatagatttagagggatagggttggagtattgttgttttaggttggtgtttagggtgttggtagggtggaagtagtgggtgattattggtttttaggattatggtttgtggtaggtaggtggtttggggtaaagggttgggttgtttttgtttttaggaaaaaaaagttttgggtttggatttttatttttttgtagtttaggaggaataatttggagggaggttggaaagtttagtatttttataatggtagaatggtttttggaatttttttatttttgtttttgttaatttggaggtttttttttttgataatatttttattatttatgttagttgtttgttgaggaagaatttgtttaggttagggtttatattttagggattatttatttagtattttttttattagggttttttttttttgtttggatttaagggaaataaggagaagttttagttaggtgaaaggggtaggggttagaggttagtgggattggagttggagatgttttatgttgttggtagggtttgtatatgaggttttattgggtttttagtggttattgggtagttttaatgggttagattatagtggattaaagtttagtttttttatttagttaattttgtaggggttgaaaaggatttttattgtttgttttattttttagtgggtttttttttttagaagatgggtttttaagatttttttgagggtagggtaggtaggtggtagggggtatttattttgtttagggttttggttttatatttattgtttttatttgttgtagggtttttttaggggtgaagttgttagttttatttaagtattttgttttttatttgatgagaaggttttgtaggtaggtaaatttatagtgtgtggtgtttttaattaggagaggagataggaggggttttaatgttttagtggagaaattttgtttggattttatttttttttttttgtttagaaatgttggtgttaaaagtagagtttgagggtagttttatgggtaggagggtaggggaattatttgttttgtagttgagtataggatatttggtattgtttttagtttgggggatattggagtgattagtattagtttttgtttttggatagtttagtttttgttttttagaaagtttttggttaatgggagatggtatagtgattaggttaaataggagtatggaaggaagttatagtggagaagttagggtagtgggtttttgtattattggggtgattagggagagtaggatgttttagtaggggtttgaagataggtagggggttgggttgttgggaatgggatgaagtaggaattggagttgggattttaaagaaaatttgtggtttatagggtgttatttttatggttttatttattttgtgtgtgtttagagtatatatatatagggatatatataggggttatgtattgtggatgattatttataagtttaagaattagtaatgttaaatattgtttagggatatgtgtattttatataatatatataagtttaagtttgggatagtggttattttttagggagattgggtaggagattatgggtatttataagtgtttttgggtttgagttggtggttattttagagtggttattttattgttgtgttttgtaatttttatatgaatatgtggtgtttggtatgtgtaattgttatataatagaaggttttttaataaggagggtagtgaatggtattattggaggtggggagttgggtagggaaggtaaataaagatatttggtgtttttttatgtgatgaattttgtttttatatatttgtaagtgttttttgtgatttttttgttatttttattattttatgaaaatggggtgtagatgttgggtattatggtttatgtttgtaattttagtattttgggaggttgaggtgggtggattatgaggttaggagtttgagattagtttggttaatatgatgaaattttgtttttgttaaaaatataaaaattagttaggtttggtattaggtgtttgtaattttagttatttaggaggttgaggtaggagaattattggaatttaggaggtggaggttgtggtgagttaagattatgttatggtattttagtttgggtaaaagagtgaaattttgttttaaaaaaaaaaaaaaagaaaaagaaaaagaaaagaaaagaaaatgaggtatagagaatgtaagaattgtgtttgttttagttttatagtgtataaggttggagtgggatgtagaatttatatatttggttttaggttgttttattgtagagttatatggtttttttttaagttaaaaatgtttagtttttatttggtaggttagtaggtagggttggggtttttattttgtttagtttttaagtgtttttagtgttatgttggttgtttttgtttaggtttttttgttatggttttgtgtagggtggtgtttatattagaattttttgtagattgattagtagtatttttatttaatattgatgggtagtgagagttggtaggaagaatggggtttttaggttggagttggagtgtgtgattgttattttttggtttgggtaagttatttttatttttttagtttttttatttataaaatgtggataataatgttatttgttttttagggatatgaggattaaatgagtttatggtgtgattaattatattttatatttttattgataatatttggggtggtttttaaggatgggaaagatattttaagatgttgtttattaagtgggaggtaagaataaggtatagtttttattagtttgggtgttaggttagttatgaatttatggggtttttgatataaaaatttagtagtgttgaaggtatatttttagggtttttatataagattgttggaaagtgggttttattattttataattgttttgataggttttagatttttttttagttggagttagtggtgtttaataatgtataggttagagaggtgtggggattttttttttgtgtattttttgatagtttttgttattggttatttgtggtatttaaggttggttattagggtgtagtagaggtatgtttatagtaaagttgttggtttgttttaggtttatttatttttaatttttttaaatttgttttttataaaaagttttttaaatagtaagaattttttgggtagagaggaagagaggaattgtaggtagaggggttaaggggaggtaagttagtttgatattataggtggatattggaaaatatttaggttgtatttagttgggtagtttttgtagggtgggtttggtaggggtggtggtaggggaggagtgtagataggggaaaggtttgtgtgtttttttatatttttttttaggtatgaatttttattttgagggagtttggtgtagggttggagttgtagattttagagttgttttttgttttgggttttttggtaggttttttgtttatagtatttttttaattttgtaaggagggtgggtgtggggagttttggatatgaaatgagataatttatgtttagttagtggtataggagtgtttgatgttttttggtaattgttattatgattatttttttagagtaatagttttttaaaaagttttgtggtttttgggatagttttttaatttattaaaattttggtatattgtatttattttgtggatgatgaaaattgaggttttggaagattaagagatttgtgttttttgttttattgggttttttagttaagtgtttttttagaataaagtggttttttttgttgtatttttttttgtattttttttttttttattttaatgagaaatgaagggatagagagaggaaggggaaggaaatgtttgggtttattttttttggggtgttattgttaggagtgggttgaattgtggttttttaggggtttttatttatttaaagatatggttaaggtttaggttttggaatttatgattgtgattttatttggaaaatgtttttttttatagatttattaaggatttttaaatgggattatttatttagggtaggttttaagtttaaagataggtatttttgtttaaagataagaaggaaagagggtaggtttggtggtttatttttgtaattttagtattttgggaggttaagtaaggtgggtagattatttgaggttaggagtttaagattagtttggttaatatggtgaaattttgtttttattaaaaatataaaaattaagttaggtgggtggtatgtgattgtaattttagatatttgggaggttgaggtaggagaattatttgaatttaggaggtagaggttgtagtgagttgagattgtaatattgtattttagtttgggtgatagaatgagattttgttttaaataaaaaaaaaaaaaaaaaaaaaggaagaggagggatgggatagagatatagggaagaaggttttgtgataatggggtagagattagagtatgtgatgtttttataatataattaggaatgttaggtgttattagaaggaggaaggtatggatgaggttggtttttagggttttagaaggaaatagtttttgattttggatttttggtttttggaattgtgaaaatatgtttgtgttgttttaagtttttttgtttgtgttaattggttataatagttatttaagagattaaggtgtgagggttttaggaattttagtagggtaaggggttgagggtttatttggtttatagagttatagtttattttttttttaggtttagagaggttgggtgatttgtttagggttatataggtgtttatgaaagagtttgtattaggatttagaatttggtggtttttattttagtttttgtttttttgaatttttttttgtttggggggaggtttggggtggaggtatttgtataggttatttgtttttttatttttttaagggttgaatggggataaggagatttttttttttgggtggggtaaggtagtggatgaggttttatgagtttttggtttaggtgtggtttataggttttgggttagtagaagagattgtttttttatttgtttggagttttggtgtttgtggtgagtatttttgatggtattttatttggttttttttttaaggatttttttgttgttgatttggtatttgtggttattgtttattatagtaaatgggattattttttggggaatgggtagatggtattggttatatatgtgtgggaaggtaatttttttttttgggtttttgggaggagttgttttgagtttggggttttttaaaaatgagagttttagtttgatagtattgggtatagatatttgggtttagtgttttttggttttaagaatataattttatggtttaaggttttttaaatttttaatttattttttagtaggaattgggggttttttgggaataatattttagtggatttatttatttggaattttttgtttattagttggttttttgagtttttattaaattttttttgggggtatatgttgatgttgttggatagtaggtttgtggtgatttgggataaggagggagagagatgggtttatttttgtggtaagttttatttatttattggtgtttgttatatgatttttatattgtgtgttgttttaggtttgggtttaagggtaggttttggggggttgtgatattaattatttttaatttttgtgttttttggagggaagaggggtagttgtaggtgtatttgttgttttgagtgatgttgtaattttttaggggtttaaggttattgttttgagtattttttatttttttttttttgtttattatagttttaagaaagtatttagggttattgagatttttttttttgaaattttttttaaaaaatttttgttatagtttttagttttagtaggggttttgtttgtagtaattttttagttttttgttagtagtttgatatgggtatgtgtaatagaaatattttagtgagtggttgtttgtttgtttaggtatagattatagtttgtgtgtagtttttggtagatatatttattttgtgtggattgtttttttttgtatatgttgggaaggtttttgatatttggttttaggatggagtaggttataggttttatttatatttattgaggtagatgtggtgttgtagtttaggtattttggttttattttgaaaggtattttatgtggttttgatgtgttgttttgttaggaggaagagtttagggttgtttttttgtttggatgtttttttttattttatagtaggggttttagatggtggtggagaagaaggtggtagagattattttttttgaaatttttttttttttttttttttttgagatggagttttgttttgttatttaggttggagtgtagtggtttaattttggtttattgaagtttttgttttttgggtttaagagatttttttgttttagttttttaagtagttgggattataggtgtttgttattatgtttgattaatatttttgtatttttagtagagatggggttttattatgttggttttaaatttttgattttaagtgatttgtttgttttggttttttaaagtgttgggattataggtgtgagttattatatttggtttagttttttttttatttaataaaaattaggtagggtgaggtgaggtggtttatgtttgtaattttagtattttgggaggttgaggtaggaggattttttgagtttaagggttagagattagtttgggtaatatggtaaaattttgtttttattaaaaatataaaaattagttagatatggtggtgtgtgtttgtaattttagttatttggggattgagtttgggaggtggaggttgtagtgagttatgattgtgttattatattgtaattttggtaattgagttagatttttttttaaaaaaaaaaagggggggtataaaataaggtgggttatgttgtatggtttttgtttggttttattttttggaagagagatttattatttgtttggtttaggttttttttaaaattttttttagagattttgttggagaattggtatttttataaagttgtttttgagatatgggggagttggagaggttattttagggatggtttttagtagttatttgggttagggattattaggttagttatttgttggggagagtgattagtggtttggtttttttgatagtgtgatttttttagatggggtggtttttgttaggtttgtagtgtttttaggttgtatagaagggttggggtaagtagagatggaattttatttgttgtttgaagtggatttttttttttagggtgagtgtgtttgttttggtgatgatagggatgatgttgattattttgtttaggtgttttataaatttgatgtttaggggtttgaggttgaagtagagggatgtgtgtgaggtttatttgggggagtggggtagtgggggggtatttatttttaagtaggtgttgatatttttaggtgttggtttggggtttatgggggtttttgttggtaaggatagggttttgggttgagttggttatgttgtgagtgtggggtagaggaaggatatgggtgtgttttagatataggtgatattattgtataggttaggtgggttagggttagttttaagtatttttgtttatgagttttggggttttaattatatttttatatgtttatatagaagggttgttgttggtttagtagttgttttgttgtggggttttggttgggaggggagaggtaagagaaatagaagttagtattagtgtgtggtgtttttgtattaggtgggttgtttttttgtattaggtgggttgttttttttgtttgtttggttttagtgagtttggggtttgatgtggggaaagttgtgggtggtaggggttggtagggttttggaattggggtattattttttttagttttggagttgagttttttttatagtgagaataaattggttatatatatggttggggagaagtttgttttgggtagaagtttaagtagagatggttaaggtttgtttttgttttatgggattggatgttttgggtgggattaggtaatatgtttagttggagttttagttaaagggttagtgttggggagtggtagaagtgttatagattgtttgtttgtttttggtttgtttagttggtattaggagaggtttttgttttttgttattagttttagttgaggtaaagtttggagtagttggaatagttgttataggattgtaggtgagttgttttgtttgggagggtagatgtttagtttaggagaggtttatggatagtgggttggttttttgtttttgatttttgttggtttatagaggatgatgttagagggtgggtttgaaaattttggtttgggtttttttatagattttgggtgaggtttgttgtttattagttaggtttttttttgtatttggtgtttatagagtatggtttttttaaatttttgggttttttttgtttagggaagtatatttgggatagtaggtgtgaaggattttttttatttatttatgtagataagttatttatggttgtttttattagttatttttgttggtttttggtttttttttttttagttttggtttagggtgagttataggtgtttggtagggggtgtatagggagttgaggatagagggtttgtgaggttatgaagagtttatttgttagggtatatgtagttttttgtttttgttgatttttaggggtgatgttaggtgtggatagagttggtgggaggaaagggtttttattaatattaatagtagttttgtttagttttggaaggggttagtattgatttttgtgttttttgtttaagaatgtattaaattttttaaggggttttatgaggtagggtttggatgagaaggttagttattgttatgggtgtttggttgggggtttttattttatttgttagagtttggtttgagaaggtaggatatagattattaggttttagaatagtttagggtttgtttgatttttagttttttaagatgtagttgaaggatgggggttgggtaggatatttgtataggggttagtgtgaggttttggaggtgtagatatggtatatttttaattttatagttggtggttatggtttttgatttagtttttttgtatttagtagtagggtagatagtattgttttgtagttttaggggatagagggaatttagggtatttggtatgaggatgttgatattgtagggatgtatgagtggttggtggtggggatgaagtagaggtagtagtggatgtgggtgtttgggatgtgttttttgtggttgatgttgatttttttttgtaggtattttttgtattggttattgatgaattttatgatgggttgttagttgtgtgggggatggggatgagttagtaggtatatgagatgttttttttaagtaggttgtgtatttttaggatttagagtttaatattttattttttaatgaaatgtatgttttgggaggtttggtttgttgagtggagatgttatagttttatttttggttttttaaattagtttttttgggttggttttaggtgatgagttggggatagtaagattttttaggtaattttgttttggtttagaatttttaggtttttgagatgtgtggttttggtagtatgttaggttttaggaggtgggttttgtatttttgtgggttgggaaatttttagggttgattttgggtggggtttagggagttttgaagtttttgttagtgtttttttttttggaggggttttattagtttttgttgttgatgtggtttttgaattttggtgtgttaattattgttagttttatttggatgtttttttttttaatatttgtatagagttatggatgtagagttagaggggagatggaagatttttatagatattttatatttgattgattttggggtaattttaggtaggtagtgatgataattaaggagatattgggaaattaatggttttttttagttaattttggtataggttggtgatggtttttttgggagttttttgtttgttagatttttggtggaaaatttagttgtttgtggggagtttagtgtgatggggtttataggggtttgggatattgatttattatagttagagttttaatatgtttaatatgttggggatggtgggtatagtgagtttttgttttggggatttgggattgtttgatttgggtatttttatattgtattagtgttttaggaaggtatgggtattttatatttttagtttatttttagttattgattgtgtgtgatggttttgatttttaatttttgtgttttaggaaggtaggggtgttttgtatttttagtttatttttggttattgattgtgtgtgatggttttgattttttattttgtgttttaggaaggtagaggagttttgtatttttagtttgtttttggttattgattgtgtgtgatggttttgatttttaatttttgtgttttaggaaggtaggggtgttttgtatttttagtttatttttggttattgattgtgtgtgatggatttgattttgatggttttggggatgtgtttttttgaggtgggttgtattgatttttggttgattttggatttgaagagggtgttgattaaggtggatttatttaagttgttttgttttggggagaggatgggaggttggttaggggtttttttggagagattagtagggtttgtatatggggttttttttatttaggtatgaggttttttagtttgagatttagtagtgtttgggttattttttggtaatatttttgttaagtagtttttgaggattttatttttgagttgggtgtttagtgattgtgtaaatttatatagttgggttttgatgttagtataatttaggttatagtttttttttgagaggtgagttgggtttgggagagttggtattttttgtgttttttgtgttttttggataggaggttttttggtggtttagattttggataggatagaggttgggttggtggaggagtttagggttgtttagggtgtattaggtggttgggatttttgtagtttattagggtggttgtaattaaagtttaggtgtttaaattgtttttttttgattggttagggtttgggtaagttatttgattttattgtgttttagttttttgatttgtaaaatgggataaatagttttttttttgtggagttggtgtgagtattaggtaggtttatgtatgttttatggggtttgtggggttatgtgttagggggtgttggtttgtagggtggtgttatttgagggatagtgattgtgtgtgtagatagttagtttataggtgattgagataaatgaggatgaggaagtagtatttatatgtaatataatatatataatttatatatattttatatatatattttataatatatatattttatatgtataatttataatatatatataatttattttaaatatattttttatatatattttatatataatttttataatatatataaataaattatatataatatgtgtgtgtgtgtgtgtatatatatatatatatatatatatatatatatatttttttagatttggagttttattgttttattttgtatagagttgttttgggttatgttagtaatatattaaaaaaaatattttaggttaggtgtggtggtttatgtttgtagttttagtattttgggaggttgaggtaggaggattgtttgagtttaggagtttaagattagtttgggtaatatagagagattttgtttttatattaaaatgtaaatattggttaggtgtagtggtgagtatttatagttttagttatgtaggaggttgaagtaggagaattgtttaagtttaggagtgtgaggttgtagtgagttaggattattgttattttagagtgatagagattttgttttttaaaaaaataaaaattggttaggtgagatggtttatgtttgtaattttagtattttgggaggttgaggagggtggattatttgaggttaggagtttgagattagtttggttaatatggtgaaattttgtttttattaaaaaatataaaaattagttaggtatggtggtatatgtttgaggtatgagaattatttgaatttaggatgtggaggttgtagtgagttaagattatgttattgtattttagtttgggtaataatgagattttgttttaaaaaaatataatataaaaaatattttaaattatattgatgttttgattttgataatatttttttaggaaaagtgtgggtttttgggaggatagaggttggtgttgggaatttttggtttgaattgtttagtagtttaaggatggatattttttgtttatttttttttgtttattaggtttgtgttttggttaattttaggttaggagttatgttaatgttttagttatgatattttagatttaggagatgttaattgggatattgtaaggtgtatttttttattattgttatttttattattattattattattattattatttttattattattattatttttattagtattattattataatattattattgttattattattattttattatttttgttattattattatttttgttatttttattattattattattgttattataattattagtattagtattattattaattatattattattattattttattattattattattaatattattattatttttattattattattattattattaatattattatttttattaatattattattatttatattattattataattattattattataattattattattattttttttattattattataattattattattattattattattataattattattatttatattattattattatttttattataattattattattatttatattattattattatttatattattataattattattattatttttttattattattattattattattattataattattattattattttttttattattattataattattattattattttttttattattattataattattattattattttttttattattataattattagtattatttttattattattattataattattattattattattattattattattattattataattataattattataattattattatttatattattattattataattattattgttattattattataattattattattatttatattattattattataattattattattatttatattattattattataattattattattattattataattattattattatttatattattattattataattattattattatttatattattattattataattattattattatttttattataattattattattatttttattattattattattattattattataattattattattataattattattattataattattattattattattattattattattattattataattattattattattattattataattattattattattattattattattattattattataattattattattattattattattattattattatttatattattattattattttattattgttattattattattattattatttttattatttttatgattattattattattatttttattattattattattattattataattattattatttatattattattattattttattattattattattattattattattatttttattatttttattagtattattattttattattattattgttattattatttttattatttttattattataattattattattattgttgtaaatttttgaataattataatttgttggggattttgtttggggtttagtttgtttgattttattttatgggatgattttattttatggatgaggaagttaaggtttatagaggaggagtttaggggaagatatataagttttattttgttgagttaggataaagttgggattttttttggggtttgtggatttttaaataggtgtttttttattttgtttgtatttttgtaggtgggtatagttgttatgggagggaggagggaggagagtagagttgttttatgttttgttttttatttggtatttttgggagggagtgattttgtggggaattaggattattgttttttttagggttgaaagggtgaagaggtttagataggtgaagtggttttttgtgtattatttttagagggtaaggttgttatagtggtagttatggaaggtgagggttgttgggttgtttttttttttttttggggttaaagttttggaagaaggtttgtgttatggttgggatgtagaggtttttaggttttttttattttgtttttggttagggagtagggtagtttttttgtagtttatagagatgagttttagtttggttattgtttttgggttttttttttttttttttttttagttatttttttgggaggtagttttgaatttttagggtataagtatgttttttataataggtagaatagggtgggggttgtaggaggggattttatatttttgtttttttttgaagtaggttgttagtttttaggtagttgtgagtatagtagggttatgagtagttgggttttatgaggttataggaagtagagaggatattaagattttaggggagttagggtttagattagtgtagaagaggaaagaaaggtgttgggttggtaggtgtgggtttgtgtttatagagttgggtaggaaggatgtgtatggttggtaaaggttagagaaataggtttggtttgagaggtgtttagatattttgtagaaattttgtaagtttatttttgtttagggtgtgatttggtgggggtatttttttagatttttttttggattttgtggagtgggtagaatatagttttgggagttaaaatggtggttgtggttttttgttttgtgagttaaggaattttggtagttttttttgagttttgtttttgtttggaaaatgggatgttttttttatagggtttttgtgaggtttgaatgggatttggggggttttggaaataataggtggtttattgtagattttagtttggtttttttattttgtttaggttgtgttgattgatgattttttgtggtgatttttagttttttggggttattagggggtgtggaagttatgaggttttaattttagggtagagttgaagttgagttgttgggaagtttttggttggggtgtggtggggtgtggtggggagtttggagggttaggttggagtaatagtgaggggatagttgttatagaattttttgtataagttgatgttattgtttagaggtagtgattatttattaggatttgttttaggttggtttgggttttttaaagttattttaggggttttggatgtgtaggataggtttttttgaggagttgttggaggttgtgggttttttttaggtgtatgtatgtatatgtaatgttattggtaatttgtttttgaggttagggttgttgttttattttatagaagggaagattaagtttaaaggtttgtgggttgttttgggggttgaggttggtttttggtattggttgagtggtatgtaaggtgaggatttattgattattatgatgttgaatttgaagttttgttttatggttttttggtgtatttgttttaggatggagttaatttttatgtagttgaagtttattggggtttttttgttttgtgatgtaggtgtttgtttgagtttggtatttttgggggtgttggttatgttgttaatgtagttgggagttgttttagtggttggggaaggaatagtagaggagttagagtggaataggggtttatatataggtgtttgttaggtggttgttatatttatttttggatggggaaattgaggtattgaggtttagaaaggttaagtgatttgtttaggtgatttttgagaatttttttgggtggatgtttttggttgtggtgttttttaaaaagttgttattttgtagttatgttgtttttttagtaaagttttatttttagatttttaaggttaggtttttttatttttttttttaggagttgtgttaagttgggggttttttgtgttttaaggtagggttgattttgaatttttgtttttgtattttggagggttgtttagataagggtggagggtgttttttttttttggttttttatattgttttgggttatttaggtggatttggtttttttttttatttttatttagataagttgtattgtttgttgttatttaaaggttttagaagttgatttatgagttaagatataggagggatggttttgtaagaaatggggatagaattagtgtgtgtttttgttttttatatttttatggatggttttgtaagaaagggggatagaattagtgttggtttttatggagttgtgtgtttaattttatagaatgagttagtagttttgggagaaggaaaagtgttgggtgtagggtgggtgtttggatgtagagttgtttttgggtttatggaggaggggggtttttgtattatatttgtttttttttggattgatttaggtggttgttttgtgtgtttggttagtgtttatgggttgtatatttataggttaagattaagttttatttttgggtatgtggggtatgtggagttgaattttttgaaattattaaagttttttttgtttgtaggtttttttgatggttttgtttttggttgttgttaagatattatatatgggttagaggtttggggttgggggtggatgtttggaagatgtttgttgaggatttaggtgtttttatatagtggggttttaggggtatttaggatggggttggtttttattagggttggttggtatatgggttaggttttagtatattttagatttgttatatttattggtgtatgtgtatgtaggtgtagataatttgttggttatagaggtggtgtttttgttagtttttataggttggagttgtttttggtggtttttagtttttatgtaggttgggtggttgttgttttgtgtttttgtttttgtttgggtttatttaggttttgttttgtttgtggggagatttttgttttattttgttttttagggaggatttggttttaggtattttgtgttaagatagggattatatggtatgtttttaggtagggttttttttgttagttttttgggaggggagtggtttttttttgggattggtgggtatttagtaggggtagttataggggagtggagttggtgtgggagttagggttatagtatgggaggttgtagggggtttattttttgtgataggtaagtgagtagtttttttagataggaggtagtttttttggtttatgtttattttttattttgtttagaaggtgggaggtaggtttttaggttaggaggggtagtgggagattttagtttaattgtttttttatttgtggggtaagaattgaatttaggaaatgtttattgagttttttggttgtagtttgtatttttagttgatttaagttattttttttggtttattttattggagtggttagagggtgttggagggaggttttttaggtttgaggtattagaggtgagagaggaaaagattttggaagttagaaattgggggttggtttatttttataggtatttttttgtttttttagtttttatagggtataggaatttttattttatggaattgggggaataaaggaataatataattttttgttgggaaatgttaagggggggtttatatatttttattgttgagagtaatatttataggtggatttggaggttagggtttttttttttgtgtttttatgtggtttttatttaggttatgtagtttggaagtttttagggttttgtttttgtttttgttttttttttagaaatatttttttttgggtttttaggatttttaaataaataaagatatagttttgtatttggttatggattatgtggttttggggttgttttttgaagttagatatggggttttgttttgtggggtagtagtttagtttttatttatgtgattgaaaattgtttttatttgtttgtgggtttgagagttattttgtttgggattgggattagtttttatttgtttttatttttttttagtattttttaattttttttagtaggatttggggggaggtgttgttttttgaattttttttttttgtttttaatgtttttggagtttagagtgagggaggggttggtttagttgtagttgggtttttttataggtattagtatttattgtagaaatttaaattaaattaaatattttgtttattaggggttttgtttgagaaataataatataatgtagttgagttttatttttgttattgatgtagggtagtggtttgttttttgtataggtgagagttatttttgtaattttttttttgagaggtggttttgtaggttttggttggtttgtaggtaggtatgtatgtagagagtaatgtaagagtttgttttgtttttttatttggttaggtgagttttggggtttgtttttaggatttttaagtgggaaaagtagagatttttatatttagagatatttttattttggttttaggatattatggtgtttagatagttggaaataatggtaaagattatttattttattgtttgtgattatgatattgtttgaggtttgtgttgtttagtgtggtagttattggttatgtgatttttttttttaattgttataatgtttgttatggttattattttgaagtgtgtagtttagtggtgttaagtatatttgtattgttgtgtaataaatttttagaatttttttattttgtaaaataaattgtttttattaaataattttttagttttattttttaagtttttggtaatttttattttgttgtttttttgaatttgattattttatggatttggtataagtggaattttataggattgtttttttgtgattaaattattttatttagtgtaatatttgaaaggtttatttttgttgttgtaggtattttaattttttttttatggttgagttaaattttttgtatgttttattttttttttttttttttttagatagagttttgtttttgttgtttaggttggagtgtaatggtgtgattttggtttattgaaatttttgtttttttaggtttaagtaatttttttgttttagttttttaagtagttgggattataggtatttgttattatgtttggttaattttgttttagtagagatggggtttttttatgttggttaggttggttttgaatttgtgattttagatgatttatttgttttggttttttaaagtgttgagattataggtgtgagttattatgtttggtttgttttgtttttgatttttttatttatttgattgtgggtatttgggttgtttttatttgttggttattgtgaatagagttgttatgaatgtgggtgtataaatatttttagttttttaagatgttgtgtatttttttgaatttatatttagaagtggaattatgggatgttatggtggttttagtttttgttttttgaggaattgttatagtgtgtttataagtgatttttgagtatttgatattgagttagtttaattgaggaatggaatttttatttttatttaaatttaaatagttatattttataaatggtaattatattggatggtatagaattttagtttaatttattttttattaatggggaaattgaggtttatagagtgatttttttttttgaaatgttattgtaagtggttaggttagtataagatttttattgaatttggtaattttgaaattttatatttttgtttgtatgatatgtggttaatatttgtgattttttttaaagattgtgggttttagtaagatggtagttgttttgttgagatttttattgtatttttaggttttgttttgttatgaatatggttgtgtaaggatttgtttgggtttttgttttttatttttttgggtatttagattaattattagtagtatttatgttgatttttagaaaggttttgatttggatagtaattgatatgttattttatagttaaagtaaaatgtagagttttttttttggttttgtagttgggagttagaggttttaggttttggtttttggtttaaagtgattttttgtaagtttttttagtttggtaaataggttatgtattttttgattttttttttagtttttgttttgtgagtttttgggtgtttgaggttgtggtttatttagtgatatttttagtttttagtgtagtttgtgagtagtataatatatttggttttagaaataattaatatatttgttaatagatgtgtggagaaatttaatgtgttgagttaatatagtggattattttttagttataaaaaggtatgagtgtgtgttaatatagatgaattttgaaaatattttaattgtaagaaattaagtataaaaagttatattttttagggttttagttatatgtttagaataagtatatttgtagggataaagtgtagattggtgatttttaggggttgggggagggggagtgattgtgtattgaggatggtgtttttttttggggtgaggaaaatgttttggaattagaggtgatgtttatagaaggttgtgaaaaaatgttatttaattgtgttttttgaattggtggatggtgtaatatggaaattatatttttatgaggatgggagaggaagggaaagaagggaaggagggagggggaaggaaatagggaaggaaggaaaaaagggaggggaggagggagggatggaagaagggaaagaaggtagttatttttagtggagttggattgaagagtttaatgggtgtagtaaattattatggtatttgtatttttatgtaataaatttgtatgttttgtatatgtattttagaatgtaaagtaaaataaaataaagagtttagtgttttttataagtgtttaggagttagttttatagtttagaggatagttgaggtttagaggttaatatttaggtttgaggtttttaagttggtgttgttagattatgttttagataaatttttttatttttttgtagtaagggtgtttttagggtggtagttaggtggaggtgttaggtggtgggagattttgatagtttttttgtaggtttttattttgaatttaggttttatgttagggtttttttgttatttattggtgttggtggtagtaggttattggttttgtgatggggattgtttttaaatttgtttattttggggattagtttttttttttttgtaggtgtttattgggttattttttttttagagttgtaggtgggtttaaggtagggatgaaagggttgtaatttatgtagttttgagttagtattttttgggaatatttgtatttagtgataaatttttattttaattttaggatttgttgaggatgagggaattagattgttgtttgtggttgggatgggggttgtaggatatttggttgggaggtagtgtttagagaggaggtagttattggatatgatatattttaggggtatttatatttattatagttttagggttgattttggtttatttggtttggtgttgagagagggtttgatatagtaggtttgtaaagtttgatttggaaattaagatttaggggttgtttttttttgtttatttttttttgtgtgttatgttgtttggtttatgttttagaaatgtttatataagttttattagttttgttggttaaatgtagagatggtgttgttggggtaagggattttgagttattgtttaatgttatttttagttttaggggagtgatagttgggtttgtattttaggataaagtgtttagggttaagttaatgttatttttttgttttttttaaatttaatttatatttggtttttagagtatggattgaaatggttatatttttatatattttgtttgttattgttaatggtggttaagtagaatgtaaggttattttttttttgtttatggaggtttgtgaagttattgattaggttatggtaggggagttggtggtatttattatattttgttagttttttaggtttgtgtttaggagaaagttgttggtatttatagttggtgtttttgttttggtgaagatttttttgtttttatttattttggtttagtgtgggtttagtagtttttttattttgttttgtaataatgtatattggagtagtttttagttgttttttttttgtaggtttttttgaatttagattttggggttagtatttttgtggtagttttatggttatttgtaggtttttttagaaatttgagtttatgggggtattttaggttttataaattaatagatgttttttgttttttataaaggggttttttaaagttgagtgagtttttgatgtaggtaatgttaggaggatagtgtttggttagggttgtttttttttttttttttatttttttgggtgtttgtaaagttttttagatttttgttgaattttggggaagttttgttttgtaattagggtttgttttttttgtttttatatagagtttgttttttgtgtttagatagtttttttatgatggtaattgaataatgatgtgtgtggtttttttttattataatttttttatatagggtttgtgaagttagatattttatttattatgtttattttagtttggttttttttagagtagtgtagggtttatggtaagttttggtaaaaagtttggtgaatgaatgaataaatgaagaaataaagtttattatagtagttgaggtttattgggggttttttgtgttaggtgttattttaatttttttttttagagagtgggttttattaatgttggttaggttggttttaaatttttggttttaagtgatttttttattttggttttttaaagtgttgggattatagatataagttattgtattgagttttaggtgttattttaaatgttgtttaggagttattataattgatggattattatataattttataaggtagttattgttattgttttattttatagataaggaaattgagattgagagggtttttgttaattatgagggttgtaaagtgagtaagtggtagagttaggatttgaagttaggtaggtgagttttaggttgttgattttttttttaggttaggtttttgggaattatggaaaggttggagaagtatggggtttttgtagttaggatttagaaggtgtagttgtggtgtaggtagtttagtattgaggttttggtttttagttttttttttagttgtttttttttagggagttggaggtagagttttgaattgttaggagaagattttatttgttagttagggaaagttgttagggttttttttagggtttagagttattttaggtttattaaagtatattagtattttagtttttataattttttttgtaagaaagatgatggtattagttattgggttgggttgggggttttagattttaggggtttttttaggtttgtttatggtttttttaggatatagatgtttatttgagaaattttagtgtattaggggttttatagttaaaataaagaggtagagttgttttggggtttttgttaaagtttttaggtagatttatttagtagatattaaaatgtttattttttatttgaaaattttatttttaggaggttgttttaggttgggttgataaaatttatagagattttaatgatgattttttattttaggtatgagtgagtgggtggagggagaagttattgttaattattaatagtttaggaaatgtaggtaaaggaaagagaatggtaaggtgatagggttggaaattagatatatgtgtagaggtgagtagattttagagaaagaattgttttggaataagatggtaaagaaattatagataataatggtagatgatgattttggggttttagtggattaggattataatattgatttatttgataagtatttattgagtgtttattttatagtaataaaaagatgatattataggtttgagagtagttagaatgaaaatagtggtggtatatgggaatttgaagtttatttatttaaatgtttattagttgagatttttggatagatttgaagtagtttttaatatgtaaggaatttataatttgatatagtagtataggatatgtgtgtgttataaatttttggtgaaaagtaaagattttttttagaaaagtatatattgaagatagatagatagatatatatgtattttgaatggtttattaaagaatttttaggtttgtggattttagttaaaaaaataatttggtattttgggaggttgaggtgggaggattgtttgagtttaggagtttaagattagtttgggtaatgtagtgagattttatttttataaaatgaaataaaataaaatgagaattaaaaaaaataaataaatttggtgtgatgagaatttatagaatttaatagggttattttagtattatttgtagtattttttaaatttttgattatatatataaagttttgggttttatagttagagaagagggagagtaggttaaaaataattatttaaggtggaagatgagtttgagaaataaagaggtaagaggagaagattgaggttagttgttttttatttttgagttttggtaggaggaagtttttaagtgagaataagttgttgtttgtggagtggattttagagtgggtggatagagatgataaggaatgttatttttggggggttttgaaaataggatatttttttattttaattttgttttttattgtattgtgtttttattgatttatttaagttattataaatattttataaatgttattggggattttttgtttttttttaaagatggaaatattgaatataaatgattaaattgtgtaaatgtgtgtgggtgggggattaaggattgaatttttaaaatgtatatagtttatttaatttgttaattaattttaaattaaattatattttatattttgtatgggataggaagtgtttttttaaagtttggttaggatttgggatgttggaaatttgagattttgttttttttttttgagatattttgaaattttgtttagaaattgagtataatggttttggttttttagagaaagatatggatttgtaaaggtaaagagttgtatttttttttgagttggagttttttttggtttttattatggggtttaaataaaattgtagttttatagtttttttgttggtgtttttttttttttggtgattaataaggtggaagagttaataagaattttgtgtgtttttttgtaggatttggaagggataggtggtgtgagtttgtttttatttagtttttttttttatttatttaggggttgaggtgtttttgaggtagggggtgggggtttttatttttattgttggttaaggtttttttagttttttttttgttaaatttttttaagtaaattttttttttattgtggaggaaggaattttaagtagttttgtttttttgttagtatggttttaattggttttagttggtaaagttaaatttggataaggtttaagggttttttatattatttgttgttttttggaagaggtttttttttgtttttttatttgtaatttattatttttttagtttgagtttttttatttaggttttgtggtttattgagatattaattttgggttagagtaagttttgatttgtaaattattattatttattttttaaagagttatttttagaatttaggttgtagggagggtaggttaaggatgaattttttgatttttggtgtggtgtgtggtggggggggttattttatattttgttttttgttgtttttttgttttgttttaggttttgaagtggatttattgtagagggagggttagggaatggttttgatgttttttttattttaaggaattttttagtaggagtggtttttattttaaagtaattttaagatttagtttgtgttagttttttagttatgtttatagtggtttgttaattagagatttttttagtttttggtaaatttgtaaatttataaagagaaagaaaagtttttttgtgggtgggtggatattggttatttgttataggttggaatttttttttattagggatgttttttaagtaggggttggggagggtagggtttagagtttttttttttttagttttttttgttattagtagatttgttagtagatatatagtagagtttagtagtgaggtaataataggggttgtgggggttggggttttgttttttttaatttatgaaattatttgaaataataaaatttagataagggtttttggggtgtaatagggtggttttttgttaggtgttgggtagaaaaaaagtttttttttaatttttttttgttgtgtagattagtttgggttttggggatgttgtagaggttgttttatgtttaggttttttagagatagtagggggttggaggtatggtttgtttgggggtaggggataggtagggaggggtatatttttgggttatgagtaggagtttgattaaatgatttttttaggagggagaaagatattgtatataattgtttgattatagttagaggggttggaaaggtgggggaaaggggtgaaggggttaattgttttaggtgtttttaatttatgtagtatttatttggattgataagagttgagagattggaattgttttttttttttgtttttaggttttgttttaggagtttttttgtttaggagtttgggagttgaggaggtttggaagtagtgggtttatagtgttattgttttgggaatttatagtgttttggatgtggtttttttggttttagttttgtaggtagtttatttggattgtatttattttttagaagagttgtttagaattttgtatgtttgaaagaaagattaattaaagaagtgaggaagttaaagagaggtttatgaaagtttatgatgtattttttaagtgtatattttagtaattttaaatgttttttgaagtaaggatggggatggatggttggataaatggatgggtgtatgggtgtgtgaatgggtgagtgggtgggtggatggatggatagatggatgaatggatgggtaggtggatgaataggtaggtgaatggatgggttggtggatgaatgagtaaatggatgaatgattggatggatgggtggatgagtagataggtggatgagtgaattggtggatgagtggatagatggatgagtggatgagtagatgagtgaatgggtggatgagtggatgggtgggtgagtggatgagtagataagtggatgggtggatgagtggatgggtagatggatgggtgagtggatgtgtggatgagtggatggatggatgagtggatggatggataagtggatgggtagatgagtggatggatagatgagaggatgggtagatggatgggtgagtggatgggtgggtgagtagatgggtggataagtggatggatagatgagtggatgggtggatgagtggatggatatatgggtggatagatgggtgagtggatggatgatgagtggatgggtggatgagtggatggttgagtggatggataaatgggtgaatgagtggatgggtagatgagtggatggatagatgagtgaatgagtggatgggtggatgagtggatggatagatgggtgaatgagtggatgggtggatgagtgaatgagtgaatgagtggataggtggatgagtggatgggtggatgagtgtatagatagatgggtggatgggtggatgagtggatgggtgggtgagtggatgggtaggtggatgagtggatggatagatgggtaaatgagtggatgggtggatgagtgaatgattgtagataggtggatgagtggatgggtgaatgagtggatagatgggttgataggtggatgagtggatgggtggatgggtgggtgtgtggatgggtgagtgagtggatgggtgggtgggtggtaagatgggtggataggtatatggagtttatttaaggagttttagaaatatatatatatttttttattttagattttttttaggaaaaagtagtgtgtatggattgttatttggttatattttgagatagttatttttattttttttggaatattgtttggggggatgtagtatagggtatttaagtaatttttgagtttagggtagagatattaggaagtagtaggtaggttgtgattttgtaggtttgttttatggtttttgttgtttgtattatggtatgaagtttagatgtatttttggatttggggttttgattagatggagttattaattttttgaagaatgaaatatataggggttatttttgttttttagttgtagggaatgatgattatttagttttttttttttttaaattttttttaggtttttgtgtatggttttgttgattttttttttgtttttggttatttttttagtttttgttgtttttttttttgtttttatttatggagttagttttggtgttttgagagtttttttttttagttgattttatttagtttttgagtatttaatgttaataatgttattttttttgtttagatttatatttgagtgttagtttgatttatagatgtgtttttgggttttgttgtgttaggttttttgttgggttttgggtatttgtagttattgttattgttaagttttaatatttgaaggtattttgaatttaatgattgtgttttaggttgaattttggagtttttattttatttgttttttattttattttttatttaagtgaatagtttttttagttaatagttattgtagttagatttttaggggttgggtttgggttttttatttttattattttgaatttatttatttattttaaatttttattaatgttaatttaatatattttatagttattattattagttgtttttgtttgaattttttttttttaaagtattagggggtgtgtgtaaaatttattaatttgatgatttttttttatgaagttgtgattggtttttattgtatttgggatatattagatttttgtggttttagaattttgtttattattgatgtgttgtgtgattttgagtaagtaatttaattattttgtgttttaatgtttttatatgtgaaatgggataataatatttgttttataagaatgttggggattaaatgagatatttatttatgaagtatatagtgttgtgtttggttagtaaatgtttgaagtttttgttaataaaatatatgtttttaatttattttttagtttttatttatgtatagtttttttggttgttttttagtttttttaataaggttatttatagaggttttttttgttgggattattttttttttatgttgtttttagaatttttatttgtttttttgggatagtttatttatattgggttttttagtttttgttttgttttgttttgttttgttttttttgagatggagttttattttgttgtttaggttggagtgtagtggtattatttgggtttattgtaagttttgttttttgggtttatgttatttttttgttttagttttttgagtagttgggattataggtgtttgttattatgtttggttaattttttatatttttagtagaaatggggttttattgtgttagttaggatggttttgattttttgattttgtaatttgtttgtttttgttttttaaagtgttgagattataggtttgagatattatgtttagtttaggttttttagtttttatatatgtggttttttgattgttgtttggggtttgttgtatttattatttataaaattttatatgtttgaagtatttagtaagatgttgtgaatgagtgaatgaataaatgaatgaatggttagtttgttgtttttttgtttggttttttgttttttttagattagtatgggggtagttatggtttttgtttattttggtaatattgttttttttgtgttggttgtgttggttagagtttttttttatggtgtttttgtggttttggtgtgtggttgtttgtgaatgagatttatgatttttggtttttattatttttttggagttataaagtattaaggtggaaggatggatgggttttttgggatagttggggtgggaggttggtttaggaaattttttttaggaaatggttagtgtgggatgaggtgtttggtgggaggggagtggagtggggatttggggtttggttgttttgtagttagggattttaatttttatttttttttttgtttattttttaattttagtgttgggtttagggtttttggggttttttttaggaatatagaagatatagtaaggattagggatataggataggtagagtttatgggtaggaggtttttagttagtatatttgagtttatgtttggttttaattagatattgagattttggttaggttattttttatgttgaggtaggggggttttttagaggttattggtttttaagtattgtgtggaagatatgttatggagagttagtattttttgagatattagtagaaggttagatgttttgtggtttaaggatgatttggttttagtgtttatttatttgttgttttgtatgaaaagtttgatgtgatatggttggttttagtggaagagtgatttgggaattggtagagtggatttagtaattggtaaattggatttagtaattgagatattgttaggggtttggtagaagttttttaatgtattagatttagttttgatttttatagagtttagttgagtattaaaaggtgtagaggttgagttgagtattaggggaatattgattttagggttgattggtgttgtgtgtgtattttatagtttatagatggtttatatttatttgattgtatttgatttttttttgtgaggttttttttagattttttgttttttaaagttattagttgtgttttttgaaattagagtaaagtaataaaattgtagtaatagtgtgtttttatgaatgttgtgatgttagttggttaaatgagggagtttttagggttttttatattgttttgattttgtgtgttttttggttttggtttattttttatattttttgtttttttttttttttttttttttgaggatttagggtttggggttgatttattgtgggattttaatggtgattttttggaagaaatgtttgttttttttttttatttagtagtgatttttggtttgtttatgtttatgtagttaatataggtagtagttggaatttggaagtttttggggtgggagtttgtttttttttaggtttttttagtttgaattttgggaaggagttatatttatatggtaattttttttaaggttgggagggggaaggggtttggtttgggtttgattatttttttgaggttgtgtttattgggttttttaagttagttgggttttttggttgtatttttgagggatggtaatagattatagtgtaaattgtttattggttggttgggtagtgggtgtttagatgtgggttagggtttttgttttataggttgtgtggtggtttaaagtgggtatttttatgggtatatatttgtgttatagtttatttgtgtgtgtgtgtgtgtgtgtgtgtgtgtgtgtgtgtgtgtgtgtgtgtgtgtgatagtttagaaatatggtaatttatagtttttttaagatgttggttttgggagatttgtttatttgggggttttagtatttttagttttttttaggaaggttttgttttttttggtttgaagttggttttagggaagaatttttttagaaaaataaaagttattttttttagttttagtttagtttttttttaggggtgagttatattaaatttattttttttttttttttttatttttttttttatgttgtaattagttgtaagtggtttatttatttaggtttgttagtttattatagaaaagatatttgaattttgtattttttttttttgatttgttttgggttttaataggtaaaggaaattggaagttagtagttaggatttagttgtaggtttttggggttattttgtgtttttattttagttttatttatttttgtgttgatttaatgtttatttattttagtttatggagtgaggtttggatttaagataaaataaagggggttttggttttttggggtttatagtgtttggtgttggtgagataattttagagtatagtatagagaaatggttgtgatatggatttgtagtatttggttggttaagtatagtaatgtatttttattaggtttgggttttttagtagatatatggtttaaaggttggttggttaaattatatgattttgtaattatttaagagaaatgaaaatatgtttatataaaaatttgtagattagtatttattgtagaattttttataatagaattatgttaaaaagtagaaataatttaaatgtttattagtagatgaagagatatatagtgtggtttatttatgatggaatattatttggttatgaaaaagaatgaagtattagtatttgttataatgtggatgagttttgaaaatattttattaagtgaaaggagttagatattaaggttatatattgtatgattttatttatataaattatttagaataggtgaatttatagagatgaaggtagatgagtggtggttaggggttgagagtttggagttgggaatggggattggttaatgggggtagggttttttttggggatgatgaaatgtgttgggattaatggtgatggttgtgtaattgtgatggttaattttttgtgttagttgggtgtagtggtttatgtttgtaattttagtattttgggaggttgaggtgggtggattatgaggttaggagattgagattatggtgaaattttatttttattaaaaatataaaaaaaaaaattagttgggtgtggtggtgggtatttgtagttttagttatttgggaggttgaggtaggagaatggtgtgaatttgggaggtgaagtttgtagtgagttaagattgtgttattgtattttagtttgggtgatagagtgagattttgttttaaaaaaaaaaaaaaaaatttttgtgttaattggattgggttatggggtatttaggtaattggttaaatattattttgagtgtgtttgtgaaggtgtttttggatgagtttaatatttaatttttttattttttagaaagtttagtttattgttagtatttatttaattttatataaatatgttttttgaggttgaagtaaatttgattggatgttttgtgtgaaaattaaatataaaaattggttaggtgtggtggtttatgtttgtaattttagtgttttgggaagttgatatgggttaattatttgaggttaggggtttgagattagtttggttaatttggtgaaatattgtttttattaaaaatataaaaaattagttatgtgtggtggtaggtattttgtaattttagttaaatttaggaggttaagattggagaattatttgaatttaggaggtagaggttgtagtaagttgagattgtgttattgtattttagtttgggtaatagagagagtttgttttaaaaaataaaaaaattaaaaagaaaaaaaattttttaaattgtttttgtagttatttttaagtaaaataatagagttatttgagttgtttattttggaaaaattagatttattaaatgaatttttagttaataattgattaagaataatgttaatattatttgtaggaatgttgtgttttttaggatttgatatttttagtgattgagaattattatttttttttaaattttatttatttatttattttttgagatggaattttgttttgttgtttaggttggaatgtaatggtgtgattttggtttattgtaatttttgttttttgggtttaagtaattttttggttttggttttttaagtagttgggattataggtgtttattattatgtttggttaatttttgtatttttagtagagatgggattttattatgttggttaggttggtttttaatttttggttttaggtgattagtttgttttagtttttttaagtgttaggattataggtatgagttattatatttagttgagaattattatttttttttaaaggaaatattattattaaaaatggaatgttataaatagaatgatgttttttgtttttaaagttgatatattagagtgatgtgaaaataataataaaagtaagatattttttggtaaatttattttggggtgaatgttgtagttataagtattgttggtgagtatttttggggtaaataggaaaagggtgtaattaggagtttgggtaaagtagattgtgtgttttgatgggggtgggttttatttgattagttgaaggtaatagggtttggaatgtatattttaagatatagtgttttggtatagtaaatatttttagttgaaggaatttaagaaatggtaggtttaagaagaatttattgatttgttttttttttgaagtagattataagttttttatgtaagaggtgttttttttatatttagtggaaaggaatagttttatttttagagatagaggatttgagaggggttttagtatataggttttgttgagatttttatgggtttattgtttagtttattttttgttgttttgttatagttttttatgattttttattttttattaaatttagtataaaaatgtttaggtttaggttaggtatagtagtttatatttataattttagtattttggaaggttaaggtggttagattatttgaggttaggagttgaagaatagtttggttaatatggtaaaattttatttttattaaaaatataaaaattagttgggtgtggtggtatatgtttgtagttgtagttatttgggaggttgaggtatgagaatggtttgaatttaggagatagaggttgtagtgagtagagattatgttattgtattttagtttgggtaaaagataagtaaaagaaataaataaaaaaattgtttaaaataagtaataaataaatttaaaaaataagtaaaataaataaaaattgtttaggtttaggttgggtatagtggtttatatttgtaattttagtattttgggaggttaaggtaggaggattgtttgagtttaggagtttgagattagtttgggtaatatagtgggattttgtttttataaaaaataaaaaattagttaggtggggtggtatatgtttgtagttttagttatttgggagtttgagttgggatttaagagtgggtttagagtagtttttggggttggtagttgggttttagtttgagtttaggaagttaaggttgtagtgagttgtgattgggttattgttttttagtttggatgtgtgatagagtgagattttgttttaaaataaaataaaaattgtttaggttaatggtttttttgggtttttatttttttatgaaggtttggtgttaagtaaaatttatttgaattgttatgtttgttttttgttaatttttgttagtttaatttttagggttttagttaatgaatttaaaattgatagaaggaaagggtttttttttagattttgttttgattaggtttttgtaattttgtgataaaggtttgaaggtttgaataggaggatataaggtttgagtgagagagaattttttttgtttaattgtttttaatttggaatattagattttttttgttttagatttaaattgatatatgtgttttttttgggttttgggattggaatgatgttattggtttttttgggttttgggtttttaggtggatattagagttgtaatatgggtttttttgtgtttttagtttgttgatttattttgttaattttggtatttgttaatttttgtaatgaggtgagttaattttttataataataaatttttttatttaaatatatgtatatattttttattggttttgtttttttggatgattttaatataattattttgtgaatatagtaaaattattgaattgtagattttaaaaaggttaatgttatagtatgtgaattttatttttataaagttattatttaaatagtaataagaagttggtgagttttgtgtatttttttgtaaataagagtagggatagtgttgtttttgtttttggatgtttttagtttttagtttgagtttaggaatattttttatgtgtttttttttttaattttgtagtttaagggtgggggtggtttttagtttggtattttttttgtagttttttattttttttttatattagttaatggatatagaggtttttttatggatttttatttttatttatttatttttatttttttgagatagagttttattttgttgtttaggttggagtgtagtggtgtgattttggtttattgtaatttttgttttttggatttgagtgatttttttgttttagttttttgagtaattgggattataggtatgtgttattatatttagttaattttttgtatttttattagaggtagggtttttttatgttggttaggttggttttgaatttttgattttaggtgatttatttgttttagttttttaaagtgttgggattagaggtgtgagttattaagtttagtttttttatagatttttaaaagggttttgggtaatatagattgggatttgttaagttattaaatgatttttttaaataaagaaggaagttataaatttttatttaaaaggagtgggggatggtaatagaaatatagttagttagaagttggaagggttttatttaatttatttttaaggtttttgggtagaagggataagggaaaatttgttttttaaatattttatttggtattttattttttggatgtaagatgtagttgtgtatagtggtagtagtgaggattttggtttggtaggtttttatattttttgttgagggttttaggggttagggttgtttaataggattaagaggaaatgattataggagtttttagttgttgggggtggtttttgtggttttttgggttatttttggtgaatttattttaaatttggaagaggtttaagtttttttgttttttgtattttaaattttagttatgttagttaggagttttgggggatgagaaaaaatttaattaagttttattgtgttgggtgatataggatttagaaggagaggggtttttggattgtttaagtttaatgataattttagtagttgggtttttaagttaattagtttttttttttttagtagtttttggggagtattatggtgagttgtgaggagttagtttagtatggtatatataatgtaggggtttttttgtatttttattttataaatattagggttttttgggggattagttttttatttttgagttattttttttttattgtttttttaataaggaatagagaaggagtttttattgtttaattagatgtagaaattgatgtatgtatagagaggttatgtgtgatatggtttggatgttgttttttttaaattttatgttgaaatgtgatttttgatgttggaggtaaggtttggggggggtggggtttgggttatgggggtggattttttatggatggtttggtgttttttttatggttataaagtttgggagatttgattgttatagagtttgggagggttgggtgaggtggtttatatttgtaattttagtattttgggaggttaaggtgggtggattataaggttaggagtttgggattagtttgattaatatggtgaaattttatttttagtaaaaatataaaaaaattagttgggtgtggtggtatgtgtttgtaattttagttatttaggaggttgaggttgtagtgagttgaggattgtgttattgtattttagtttggttgatatagtgagattttattttaaaaaaaaaaagagtttgggagtttttttttttgttatgtgatgtgttagttttttttttattttttattatgaggaaaagttttttggggtttttttagaagttaagtagatgttggtattatttgtatagtttgtagaattgtgagttaaataattttttagttttggttattttttatagtaatttaaaatggatgaatataatgtattagtttttttttttggattttatagtgtgtttggttggggttgtgttttggggaaatggtaattgtgaggtttttatagattgggtttgggttttaattatagttgtattttagtgttttgatattgttgagtggatgtttaaaaagtattgttgggtgaatgtgtgagtgaatgatgaagatggaggtggttgttggtgttagggtaaggttttaggagtttggggaggtggtattaggtagtttaggttaatggttaattttggatagggttaggaggtagttagaatggttaaggatagttaagggattttaggtaagtggttttattttttttaggtgggtaggaagtaggaattagattaaggggtgttaggtggtagtggtatttagggggtttgaggagtaggtgtaggtttagtagggttggtggtgttatgtgtggggttgattgtggttttgtttattgtttttattttttggatgtatgggtttatggtttttaaggtttttttttgtttttatgtttatttttttaggttttatttttagatgttaagttatttttttatttttattttttttgttgtttttatatttgagttgattttttttttgagttttggtgaaattttagagagtttagaggtgtagtttatatttttgtgttataaggtttttgtagtttttatttttttgggatattttattttagagttgggtgtgtatttattttattggattagaaattttaggaatgtttattttgtatgtttttgttttttattttttgtttgttatttagtttgtggttgttatgtggttgggttttggtagttattgtagttggtaatatataattagtatttttgtgtttaggttttgtgttgagtttttttagttttatttttgtttgtttttaaaatggtttttgatatggtaattattattatttattttttagataaaagattatagttttaggagaggaggaatggtaggtttgaggttatgtggtttgtaataggtaaatggatttggtagttattttatttttgagtggggtttttttttgtttgtagattttgttgaggttttagagtttggagttagtgagtttttattgagtataaggatagtggtggtgttggggttggaataaggtagggaggggttttttaaattatagttttggttgtggatttattttgggattttgttttggttgggaattttgttttagtttatttgggatatttttttattttgagttttgtattgggttgtgtatggggtttgttgaatgagtgagggtaggagggatggtgagtagggtggaaagtgattatggtgggtaggtttttgttggaagtttgaaatatttttggtgagtaggaaaatattaggggaagaggttatagtttttagaagggtttgttggggattgttttgtagtttttttattgggataggtagaaaatttagtttttttttagggtgagtttaggaagtttgtgggggtataggttttagttagggtggtgtgtgggtttatttaggggatgttgttgtggtttagagttaggttaaattttatgtattttgtaaataattatttataataaataaggtttatttattttttaagaagagtaaaatattataggaggtatttttttattaattaaatatgttatagtgattttattgtgttattgagggagggtattagggtgtttggtttagagtaaattgtggttagggggatgggtatattgttaaattggttagatttttatttttgaaaatgtgggttaaattttttttaataagttataaggaaatttagtgtgaattttatgtttttattattattggttgttttggaagattgggaggaggggttttgttttttttttatttttggttatagggtttgaggttataatttggattgggattttaattttttttttggggaagaggtttatttagggtgtttgttaaggtttagtgtataaatatggaatttgtttaatgtttgttttggtatttttgggttttttatattgggtttttttatttgattttttaagtagtgagagtgatgggatatggggtgtttttaggggagatttggggagatggagtaagttttttagtttaaggtgaggttttgaggtatggtttatgtagtgatgttttttatgggaggtttgaggtatgattaggagtttggagatttagtagaggtttgggtatgggatttttggtatgtagttagagtgagggttgaggttgtatggatgtaagtaggtgattttgtgttattgggtgttatttgtgttgggttttgtgtagttgtttttattttattgagttttagggaggtgaggtaattattttaggtatatagttttgggggtaaaggttggatttaggtgtgtttgattttagaatttaagaagataagtagaggagtttgagttttttgagattgtagtgatggtttagtgttttaggatggttaggttggtttttgtagttttagttaattgtgtttttttttagttatttagggttttagtgttggtttttgagatttggtattggttataggggtttatttttggttgtggatatttagtgttggttattgggatttggtattggttgtggggatttgtttttggttgtggggatttagtgttggtttttgagatttggtattggttatggggatttgtttttggttgtgggtatttggtgttggtttttgagatttggtattggttatgggggtttgtttttggttgtgggtatttggtgttggtttttgagatttggtattggttatggaggtttgtttttggttgtgggtatttggtgttggtttttgagatttggtattggttgtgggggtttatttttggttgtagggatttagtattgtttatggggtttgtttttggttttggggagttagtagtgtttgtggggtttatatttggtggtggggatttggtgttggaggattttgatagtaaaattatagaggtgataggtaatagtaatttattagtatagtgtgtggtttgttttagttatggtatttttttttattttgtgtttttttattataaagtttagtgtaggtaatgaagttaagaggtggagaatttgtaggaggatgtatattatatttgttttttgtgtggtgtttttgtattttgggtggttgagattttttgttttttttttaggtttttttgtgttaggtttgtgttgttttttttggttttggtttttatttatttggttttttagttatagatagtagtgatttttttttttatttaatggggttattgtttagtttattattagtttttagggttggtagatgatattggttatgggtagtgttttttttggttttagtatataaggtataaaagatattattttgttttaagatttttttagttatgtggtgtatgggaagtggtgttgggaattttttagggtagttttttgttttgggggagattgtgtttaaatttttgaggaaatgttgttttttggttttttttttgaaaaattttttaaggagattttgtgtggagtgtgtagggagaatggagatttttgtgagattgttttgggatagttttatagaaattataaattatttggataaaagttgaaaatttgtggttatataatgttgattatttatttaaatatttgttgagtaagtatttatgatgtttgggaatttaggatgtggattgataagatataatttttatgtttgttttagtgatagagagagagatggtattattaattttgtttgttgggggtttttttggagggggtgtgtaggtttagggttgaatttgtttagtggatgtgttatttatgtttgtgtattttttggttttgtggtggtttttggaataaaggttgagagataaaagataaggatttgggggagggaggatgtttatgtatattttattggggatattagtaaggatgattgtttagtgattatttagtgattgagttatttggtgtttggagtttggtatttatagagtagggtgggggtagtaggttttgttgggggtataggtttgagaagggagtgttgttagttaggtttgatgggatagagagtgaagggttttttttttgaaggttatgtagaggttggaggttaatgttagtaattttattaatgttagttttttgagattgatttagagttggggttttaagagtagttttgggtgtttaggagttaagattttatagagggtgttttttatttttagtttagggaaagtgataaatttggagtgtttttgtttatggtttaattattgaatttaaatgaatgtattgataaattgtatttagtgttatttatagggaaaagggagggaaaaaaaaaaaagaaagagagttaattgtgtttaggttggttggttagggggaggatagatgggttattatttttgttattttttaggttttttgtattgattttttatttttagtaaaattaaggtttagtttttttttgtagttttggagttggttgggatgaagtaatttttgtaggtagattattaggtttattgtgatggttttagtagggaatttagtttaggttatagtagtttaggtgtttgtagaaggtttagatttttgggtgttaagttttttttttttgtatttgttttggggtttggtggggtgggtagtgtgtgatttttagggttgatgaaagagaggaggaagaggttgagtggtggtgagtttgaatagttaattttgggaggggttgaggtggggaaggtttttattgttgttttataggttttggagtaaggtttttatgattttattagtagttgggtaggtataggtttaggtgttgagtgtgttaggatttttgttgttttttgggtgggggtgagagggatttttatgggtttgtaattagatttgtgtttttttagttaattttttattaaataaatttatatgtatagtggattgggtatggttgttatttttgggagtttttttgggaaagttttttaaggttttgttgagttttgggaataggtttttatttgtttgggaattgggttggtatttaataaataaattaaagtttggtgttggaaggtagaattttgggattagagttttagttaagggttataagttttttaggaagttttttttttaaagagtggttgtgggatgttgggagtttttagggtggttagtttttaggtttttttaaagtttaggtggtattgatgttttgtgttaaggtgagggttgtagagaggggttggtggggaggagtttttatagtttattttggttattgattttatttttaagtattgaaataaagttttttttttatatttttggttagggagagagggtggaagttttaaatatttggggtgtatgggaaaggtttatatgtatagaagaattagataatggaagttgttggtggtggtgataggttttttaaaggggttttgagatttttgatattggtagggaagttatatattgtattaggtttgggggtagggagaaggggtttttaaggatggggttgtttttttttgtggaagtgttttgtattgtttgataagagtagtttggattagttgtggtataataggaagttgggagaatatggtggtttaggaggttggttagggttggggagtggttaatttagagattttggttgtttaagtgggtttagggtttttggggtgaaagtttttgtggagtatagtggatttagtgtttggaggatagattttaggtttagataaggttttttttttttttttttgagatagagttttatttttgttgtttagattggagtgtagtagtataattttagtttattgtaatttttattttttaggtttaagtgatttttttgttttagttttttgagtagttgttattataggtatgtgttattatgtttggattagttagtatttttagtagagatagggttttattatgttggttaggttggttttgaatttttgattttaggtgatttgtttgttttggttttttgaagtgttgggattataggtatgagttattgtgtttggttaataaggttatttttgatatggaatgttggtttgattatagtgtttgatggtttttgtttgtaattatgtttttgttttttattaaagtagggtttttagggtagaagttgtatttttttattttagagtgttttatgttattttttaggtgtatatagtgggttttttttattgtagttgaattggttttattattattataatgatagtttataggggtgggggttagtgggaatataaagtggttaatgtaatagtgttttagttattttgatatagaaatggttaggggatagaaggggtaagttgggagttagtagtaatttaggtttttagagatgagtattaaaaaaggtgagttatattataggttttttttgattatattttagtttaaaagagatttaaggagaaataagaattttatttttttaataaggatttgtatattagatgttaagtaaatattttttttttttttttgaaaaggagtttttggggttgttgggggagttggttaaagagaatgatatttatggaaatatatgtggttttattaagttttaaggtaaggtggtaatgaatggaggaggaaaatttatagtattattagggaatggggtttttttttgttttttttttttttaatgggtttttttatgtgggatttaaattaaattttaattttattttgatttagtaggtgttgtttttatagttttgaatagatttgttagaaaattattgtttaatttgtttttgggtggtatatttttttttaggaaaggaattataaatttattttagatgagtagagagttgttttttaaatttttgattaaaatatagtagattttatatgaaaaagtaaagagagaggggttagggatgaagtgtagtaggttggaggttgagttagtttttagagttattgggatggtgttttaggagtagatggtattgtttataaagttttttgtttttttttgttttgaggttggggattattttgttggttgtatgatttagtttttggggtttttttagtatgaaaagattttttgaaagtaggtttgttagggagattttttagtttttgtttattgatatgtttttgtatggttgatatgtagtatgttattgtagagaagtaaagtatatgtagattagttttgttagtagtattttttttttttgttttttttaggaatgttttgtatatatttaatatatttaggaatttagagttgtgttgtagtagtagttttttggattttagtgttggtgttgtggggagttttggttatggtattttgagtattgagattatttttagtttttagttagttggtttttgggagtttagaggggtgataatttgagtggagtgattttagagaaagtggtggttaatttgaatttttttttggtttttttggaagttagggaaattttttgtgaaaaggaaatatgttttaagaagttttgggtagtaggagaatttagttatttagtttagttggttaaatatttataaagagatagttgtgattatataaagttttatttttttattttgaggttgaaaatttggtttttgtgtggagattgagttttttgttattttttttttggggattttgtttggttttgttggttttgggttggggtttagggatagtgtggtttttggtattgttattatggttattagggtttgttttgtggttgtgttatttgagagtttttgagttagtggtgtaaggttgggaagaataaaggagtaggatttattttagtagtggaatgttgggttgtgttggatgtgttgagagttgtggtttgtttattgggttatatggtttagagttgagtagaggattaaaggggttttgtggttgtggaataaggagttttttagagtgtggggtagaggtagggagggattttgattgtttgggaagggaggtttggtggggaattgttttaagggggtagggtgaggggagtaggaggagggggtaggtagagataggggtgtttagtggtaggtttggtgtagaagtaatttgaaggtatgggagggatgttaaggagttgttatatgttaaaggaaagtgatagggtttttgggaagagtgagggggagttgttaggaagaagagaggggaagaggtttttagggatttttggttatgttgtttttgtttttgtttttgtgtttgttagaggtggtgtttgtgaggagttttttttttttagttaggttttgaaattgatttggatattttttttttttgtgttttgtttgatatttttgttttttaggtgtttttttatttatttgtttagatattgttatagttgggtttttagggagtatggttagttattttagaaagttatttagatttgtagttagggttggaatatagttatttgggtttgttttttttattttaggtgtttgttggttgggattatggaagggagaaggagtaggagaggaggggtaggggatgggggtgtagtttattttgagttttttttttgagagtttttggatttagatttgatttagtttttgtttttttagtttttttagtttttgggggatttggttagtgagttagtttttttttttttttttttttgtaggtttgggatgtgttgggatttagaggggtataagtaagggggtttttagaggagggagttgatattataggggttgggtttggatgttgggatttgttagatttattttagtgttatgatttttgaatttaagtgagttatttttagtaggggtgtggttatttttatattaggagagagtgtttgggagtgggtttgttttgagggtttgttgggggttgggagggatttatttaaatggaaagaagtttttggtgatattttttgagggttaggggttgaattttggaagttatgtttttaggtagtttttatgggattttatgttgagtgttgattgggttttatatatttttattttttttattttgtatttttatatgtggttgggggtgattgaagttttggggtatttgttatattggttaaataggttagttatgtttagtggttttttagttagtagttattggtatttgatttgttgttttttattttttatggttaattttttttttaaggttttttggttttatggttttttttatttttatagtgaatggttgtggggagttgttgttattggtttttgggtgttaggttagagttgggggagtgtttgggagaagattgtatgtttggagtttttgtttttatttgaatgggagggaggttggtggtagattagagatttgggttttgagttaaatattgaaatttaaggttttgggtttgttatttaatatttgtggaatttgattttttttatttataaaatgggtattattaatattagttgttaaaattatagtaagatatatatgtttaggttaggaagtgtggttatttagaaaatatagttttttttttttttaagaagttaatttttttagtattgggagtgagaagagtttgttttttttattgtttgtagtttagtttagggtatttttattattggtttttaaagggtagttttagaaattgttgataaaggatgttagaaggaatttttttttggttaggtgttagggttaatagaaagttttgaggatgtagtttttattatgtttttgttttgtgggtttttttttttttgtgggtagaattttttttttttggtttttttttttgaatttttttttttttgtttttggttttaatttgttttttagttttttggttttttaggttttttttagggtttaagattttgtttttttttaagtttagttttttttttttttttgtttttggatttttgagttgggaggttagtattttgggtgttttgttgaggtggttgttttttttgtagtggttttttttgttgttattaaatgagggtttttagagtatagagaaggtatttttggtttggggttgtattttttatataaagtttttgttttttagtattttttaaagttttttattgtttagtatatatttagtatttaggtagagtagttttagagtttttttggttggtttttggtttaattttttagtagaaatggtatatgggttatagatgtaattttatattttttagtatttataataaaaaatgtaagaataagttaggtatagtggtttatgtttgttatattagtattttgggaggttgaggtgggtagattatttgaggttaggagtttaaaattagtttggttaatatggtaaaattttgtttttattaaaaatataaaaattagttaggtatggtagtagttatttgtaattttagttatttgggaggttgaggtaggagaattgtttaaatttgggaggtaaaggttgtagtgagttgagattgtgttattgtattttagtttgggtaatagtgtgagattttatatttaaaaaaaaaaagaaaagaaaagaaaaaggaaattattaaaaaatgtaagaataggtgatattaattttaatattatttatttaatagagtttaaaatattattaatttaatatgtaattaatgtaaaaatgatagatatttgatattttttttttttttttttgttaggattttgaaatttagagtgtattttatatatatggtatttttttatttggaattattatattttaggtgtttaaatggttttgtgtagttagtggttattatgttggatagtgtagtttggagagttttaatttttttttttttttttggttgttggggaatagagttttgttttgttatttaggttggagtgtaatggtgtgattttggtttattgtaatttttgttttttgagtttaagtaatttttttgttttagttttttaagtagttgggattataggtgtatattattatgtttggtggttattttttgtatttttagtagagatggggttttattatgttggttaggttggttttaaattatagattttaattgatttgtttgttttagttttttgaagtgttgagattatatgtgtgagttattatgtttatttttggatagttttaatttgattttaggataatattaggttattagagagttgttgatttggattatattatgatttgaattttttagattatttttggtattatgtttataagttatatttagaggataataggatatagtttggtgaaatatatagtggtattttttataagatattggtgaggttatagattttattattagtgttatttgtttggggatattttatttttagaaaatgtagagttttttttaagaaatgaatgtggttaggtgtgttggtttatatttgttattttagtattttgggaggttaaggtgagtatattgtttgaggttaggagtttaagattagtttgattaatatggtgaaatttagttattattaaaaatataaaaatttgttaggtgtggtagtgtgtgtttgtagttttagttatttaggaggttgaggtaggagaattgtttgaatttgggaggaggaggttgtggtgagttgagattatgttattgtattttagtttgggtgatagagtgagattttgttttaaaaaataaataaaaaaagaaatgaatgttttaggtatatgttaagtattttttagatgattttaaagatattaattattgtgattgatgatgatttttttttttttttgggtgtgtttgttttgtttttttagtttataggtgtttaggatttaaaggtagtttgttataggttatgggatttggttggtttaaaagggagagtgaggttattggaatttttttaggagtgagtttgaagtttggaatgttttttggtggagggttttgaagttaggaggtgatgtagatgtgggggttgagatattatttggggttatttgtaaagagggatatttaggtagtgattttaaggaaagagtaaggggaggagagggtggtatatttatgtttttttaatttttgtttgtttggaggtttatgtattttatatgttggtttttttgtatggatatttttttaataagtaatttattgtgtttatgtttatttattttaaagttatatagaattgtatttattaaaaatgaatttatggagatagaaagtattttggtggttgttaagggttggagagggtgaatggggagtgagttttttatggatatggggtttttttttggggtgatgaaaaagttttggtgttagatagtgttgatggttgtatgatattgtgaatgtatttagtgttattaatggtaaattttatgttttgtgtattttagtataataaaaaaatatatatttaaagtaatagaatttaatgtgtttttttttttttttgagttagtttgtttttttgttttatattttaaaattagaagggttttgagatatattataggtttttagggtaggttgaataattttttttttttaaattgtgttattttatgtggtaatagggattttgtagatgtaattgaagatgttgagatgaagagattatttaggtgggttttaaattataagtgttttttaagagggaggtaggttaggtgtgatggtttatggttgtaattttagtattttgggaggttgaggtaggtagattatttgaggttaggagtttaagattagtttggttaatatggtaaaattttgtttttattaaaaatataaaaattagttaggtgtagtagtatatgtttgtaattttagttatttgggaagttgaggtaggagaattgtttgaatttaggaggtggaggttgtagtgagttaagattgtgttattgtattttagtttgggtgattttgttttaaaaaaaaaaaagaggaaggtagagggagatttgattgtagagaaggaggaggttgtaggaggatggaggtagaggttggagggatgtagttgtaagttaaggaattttagtagagttttttatttaaagttggaagaggtaggaatggattttgttaatattttgattttagtttggtgagattgattggtttttgatttttagtattgtaaaggaaggagtttttgttgttttaagttattgagtttgtgataagtagttatagtggtaataggaagtgaatgtagtttttagtttatttttttgtttatagtaatataggtgtttttttgtgtagaattttgttaggtagttagtgagtgggataggatttttttttgtttttatttggggttttgtgttggattttttaaggttgttgtttttgagatagtgaattttttatatttatagagatttattttaaagttgagaaagtgttttttttaaggggtgttagaaagaaggttttaaggtgtttttgttatatgtttatttgtttgtgggtaatatttatagtttttttttgtgatttatttaatagaagggttataggggagggagtattattggttagtttattttatagtaaggttttattttggaagttataggggatagttgggatttttatttttaatttagttaattgggagaagagtttagaatagttttggaggttgatatttgttaggaagtgtggtgatatttatgtgttgttgaaatatatagtaatatagtagtagagaggaggggatgtggttttatagttttttttttatttatttagtatgtatgtatatatatatatatgtgtgtgtatatatgtattaatttttagtttttaggttttgtattttgtttttgttaagttttttggttattattaagttaggttgtgagtatagagtttagtttttttgttaatttttttttaatttattttgggtaatattttaatgggatgtagtagatgttttttattaaatgttaagagtaatatttttttttattttttgtgagttggtggttgtgtttttgtatgggggtgtggaggaaagggttggggagtaggaatgtggttttgagggttggtatgtatttgtagttgtgatgttttgaggtagtttatatttttatttatagattaattttgagaaggggttgggagtatttatagtttttgttatttttgggttggtaggttggggaaattttgagtagtttgagtgaaggttgtttttaggtaggtatggtgggatagaggggtttttgtatattttttgtgaggtagtgtagttgttgggttgttttagtatatttgggtgatatgttttttttttggtttttttttatttggtttgggagaatgtttaggatgttttaattttaaaaataagtaaattttttttttttgatttatttatttttttaaattgtgaattttttttttgtttgaatagtttaattttttaaagtaggtttatattatggtttttagttttttattgtttatttattttttagtttgagttatttggtgtttgtttgttttattattaatttagtttttgaaaaaatttttatggttagtatttagttttattttatttgattttgagggtagtgtttgatatgtattagttggtttttttttttttttttttttttttgtattttttagtgttggggtttagatagtttttaagggtttttttgttttttgatttagttttttggagtgattatatttttgttttagttttttagtttagttgtttttttatattttgttttaggttttttttttggaatattgtttgtttttagagatttaagtttttattttttatatttttttttttgatttttagtttttttattaaagttttattggttgtttttttttggtgttttaaattagtttttttttgtttagattttataaggttagtttttattttatgattgtttttttggattattgggattattttttattaatatttattttttattttgtttttttttgtttatgtagggttttgttggaggattttttttgttttattatttttttttttaaatagttttttaggtttttttgttaaagttgaaattttttttttgtatttgaggatttttgtaatttggttaatttatttttaagtttgaatttttatttttgtttaaggagtttatgttttttagttaggttttattgttttgtaaattttatttaaaattttttttggtaaatgttattatttttaggaagtttttttgatattttttattatatgtgatttttatttttagagttagattttgatttggagattttgatttttatttatttttgttttttttgagttttttaggttgtaggttttagtttatgtttgtgggtttttgtagtaggagggtttatttttatttttttaagaagtgtttgttttattttttgttaagttgtaattttttataagtaggtatttttaatatgtttttttatttttttttttttttttttttttttttgagatggagtttggttttgttgtttaggttggagtgtagtggtgtgattttagtttattgtaatttttattttttaggttttaagtgatttttttgttatagttttttttgtagttgggattataagtatgtgttgttatgttaagttaatttttttttgtatttttagtagagatagggttttattatgttggttaggttggttttaaatttttggtttgaagtgatttgttgattttagttttttaaagtgttgggattataggtgtgagttattgtatttagtttaatatgtttttttatattttttttgaaaagttattattatattaatagtgtgttttataaattgataataatttaaaatgtgatttattattaaaagtgtgattttatttttaaataatattgttggttgtggtttgtagttagttttattatttttgtgtgatgattattttgtagattagtaatggttttaggtttatatttaatttaattattttgtttttttaattttatttttttttgagttaatattaagtgtgttttagagttgtaaatttatggttgatataaaattaggatttttaatatttaatataaagtaattgggttttgtattggttttaatagtaattataaattatgtttgttttttgtattgggtatattgtatttagtttataatatgtgtttttgttttttttattttttttattaagatggtatataggtttaaatttgttttttgggagtaattgatttttttttggaagatgtgagtagtttttatattatatttaagaagatattgttataagattttatattttttattttagtttttaagggtttatttatttttttaaaaatttatttgttttgttataatatgtgtttttttttttttatttgtttttttaagatatagttttattttgttgtttagattggaatgtaatggtatgattttagtttattgtaatttttgttttgtgggtttaagtaatttttttgttttagttttttaagtagttgggattataggtgtgtattattatatttggttaatttttgtatttttagtagagatggggttttattatgttggttaggttggttttgaatttttgattttaggtgatttatttgttttggttttttgaagtgttgggattataggtgtgagttattgtatttggtttataatatgtgtttttatttttttttttttttttattaagatagtatatgggttttaagtttttttttttttttttttttttttaagattagttggttgggtgtagtggtttatgtttgtaattttattattttgggaggttgaggtaggtagattatgaggttaggagtttgagattagtttggttaatatagtgaaattttgtttttattaaaaatataaaaaattagttaggtgtggtggtgggtgtttgtaattttagttatttgggaggttgaggtaggggaattgtttgaatttgggaggtggaggttagagtgagttgagattgtgttattgtattttagtttaggtaatagtgtaagattttgatttaaaaaaaataaaataagtgggaagaggggagatagtggaataaggagtttaatttgtaattgattgtgaataattaattgagataatttattatttttggattagttatgggttttattttttatttgtttttttgagttatgttttttagtgaaattttatatgtatgtgattaaatttgtttttttttttattaatttattttgagtgagtttaatttatagatttttaaatattgaatttaagagggtagaggaaatgtattttttttttgttataaaaatattttatttttttattgtagtgttgtttgttttatttatagttggtaatttggattttgttttttaaagtttatgaaagtaggatagattgtttgtaggatgtttttgttataaaaggagggttaggtttggtaggaggaaagaaatggaagtggtaaatgtttattttttgtgttagatagaggtattaggtgtttattgttttggggagtaaatatttttaaaaatggaaagaaaaatttttagttttattggggtgtaaaaagttatgattttttttgtggttaaatggttgggtggtttgggagataagtggtagttattttgaagtttagtttatttgtttgtaaatggagggtaatgaaattatttgttgtatgggtgtttgataggttgttgtttaaattttttgtttttttttatggggttttggggaagattatatgagttagtaatataaaagtattttgaaaattatatgaagtgtttaagtatgggggtgttggttgattttaggtttgtttttataagttggtagaaaattttttagagagggttttgtttttttttttggggtaggggttgtagtgttagatttgatggtattggtggttgtttaggttatttggtatgagattgttgttagttttagatttattttaagtttgggagggaagtaggttggggtgggggttttgaaattttttatatttttggtagagatattagggtaggtaaaagtgttatttatggtaaattaagaagtttgtttgaattgggtttaaattagtttagtttagaatggaggttagttttattttttttttttagaattaggagtttagtatattagaggttgagaaaatgttggaatagtttttttatttgtttgtttagagatagggattttaagttatttttttttttagtttattttataaattttttgtgttagattttttttgtttaggagttataggttttatttgggagttatttagggttttaaggtttttattatttagttgtttattttattaggttaggtttgtaggtatggagattagtaggatgtggtttaaatttggttgtatgttgattagttgagtgattttgggtttattttttaatttttgggaggtaatgtttttttatttgtaaaaaggggaaagggtttagtgaggagagtgataagtaaaggagatggtatttgtgtagatggtattgtgtgggtgtttagtggatgattatgtgttatttttttgttttttttttttgtttttgtgggagtgtgggtagtagggagttaagaggaagggagtagttgtttgtttgggatgtaggttgttttgaattggaagagaaaaaggaataagtagtagttgtttattgataagttttatgtatttgtgttttaaaattttaaaggtgtatttgaaagattttttgggtaaatttttttttatagatatatgaaagttaggtgtagtggtttatgtttgtaattttaatattttgggaggtgaaggtaggtggattatttgaagttgggagtttgagattagtttggttaatttggtgaaattttatttttattaaaaatataaaaatttgttgggtgtggtggtgggtgtttataattttagttatttaggaggttgaggtaggagatttgtttgaatttgagaggtggaggttgtagtgagttaagattgtgttattgtattttagtttaggtgatggagtgagattttattttaaataaaaataaatttaaaaaaaaggtatatgaaaaaggtaaaatgttatgagtgttttgttgtaatgtgttagttataaatgggaattggaggattttttaagttatttttttttttattttttttttttttgtatatgtattaatagttttttgggtgttggtagtattaggggatttggggtgttttataggttttgtttgtttagattttagagttaaggaggagatataaaagttaaaatagggtggtaagtggaataaatggggattagatggggtaatttggtagtatttggtaaggttttttttaatgagtttttaaagaggtttagtttttaggggaaggaggtgttttaggtagtgggggtttgtagaggtgaaggtttagggtggggtttttagggaagttgtttaggatgtttgaaaggaggggagtaatttatgagtttggtgatagggttggttataaagtgttatgaagtattaattaggttgtttattagtttttaggatagaaagattatagtagttaaggtgtggggatttgtttatttgatttttatttagtttagaaaatgattgttttagggttataggtaatagtttaagttttgtaagttgttggttatagggtgtagttgtggtaaggtggggatgtttattagttaagttttttaggatttttgggttgttggatatgtttgtaggatgttatgggggtaggttagattaggggtatttttatttttttttttaggttttagtttttaggttagagtgttttttggtttttggggtttttagggttgtagatagatagggagaggtttgtgttatggtgggttatttggtttttgtaggaagtggttagaggttttagtatttggatatagtagttatttttttaatttttgttaatgttgttgttgtttggggtttattttttttaatttttttttttaattagggaggaaagtattttggagtaggaattgggttatttagtttgatattttagtatgattttgtatgattttgggttagttatttaatttttttgggtttttatttttttatttgtaaattaggtagataattttttaaagttttttttagttatagaattttaagtgttaaaataaaaaaaatttataaaaaggaaatatgtgtttagtttatatttttgtttttatttgttaaaaggggaaatggatttgttatggggttttttttttttaaatagatatgggagattttttttatgattgtagaattggagtagtttagaggagtttagaattttttagagtttgagatttataggggaatttattttaatttttttgggatagaagtattgttgtttaatggtatttaatttttattattgttgtagtaaatgattatatatttgtgatgttaaataatatagattagttttatattttattttattaggttatagggaaggtgtttatagggttgtgtatttttttgaggttgtaggggagattgtgtttttttgtattttttgtttatttgtattttttggtttgtggttttttttttttttttaagttttttttattgtattttttagatggtttattgtgtttttaaaaatttttgtgatgatagtgggtttgtgtggattatttaggattatttttttattttaagattagttgattagtgattttagttggttttgttatgttatttaatgtagttttaggtgttggggattaggatgtgtttaattttgggagttattattttgttaattttaagatataggttttggagggagatgaagggtaggattataggtttaggaggttgtttgtgtgggtttgaattttggttttattattaaggaattgggggagtatattatttgtaaaatgggggttggtggggaattagttttttggttgttagtgtagagtgaggtagtgtgtgtagtgtttggagtagttttgtgagtatttgttttttttttgttaaatttataagaattgattttggtttaatggtttttttaaatttttagttttttttggttataaggttaggagtatttttttgtagggttatttaagtttttagtttttttgaaagttttggtttatatgatgttggaagtagatgtgttgtgggttgtttatttatgtatggttattggagaggtttggatgatgttgtttttaatgggtgtatagtgtagggtagggttaggtattaataattagttatagttattagtgtaagtaaggggtttttattgttatttttggtttggggttagggagaagttttgggaggtatttgatttttttatagggagtggggttataggagaatgtatttgaaaggggttggggggtagtagaaagttttttttagaaattttatttttggtttgtgatagatgatttttttaggttattattggggtttatttgggtttttgtagtatggagtttggttattttagaaggatgattgggtaggttagggttattggtgatggtgatggtaggtttttttgaggtttttttattagaagtattaggaggttagagtagttgataagtttttatttggtttttgaggggtagaaggttttgagtagttttttgattttttgaggtttttttattttattgagagatttttgagagtattgagagttattttttggtttttttgtgagagagttggttatataaaggtagttatatatttagtaagatgaatttataatttttgagtttaggtttattttggtttttttatagggagtttttgggggtgtggggtgggggtgtagaagggaggggttggtgttttatttttgggaattaggttatgagttttggatttaggttaaattatagaggttttatttttttttaggttttttgttttttaattatttttgtatagggtattttttttttttttgtagggttttattggggtggggtgaggaggagttatagaattatagtagttgttatatgggggtgttaaggtagggatgttgatgttaattgaatgggtatgggaaggtagagtaggaggttggtgttttgggtttggttaggttgtgtgattttagggaatttattttattttttttggtttttagttttttttattgtaaattgagggagtgaggttaggtgatttgtataattgtgtgaatttgtgttttgtattttttatttattattttaaataatgtttttaaattttagttttttaatgttttggtatttttttgtttgagaaatatttatggttgttttttatgttgtgttttaaatataggtattttggtttttttttgggtgtttttattagggttagaatgggtagtttattttgtaggaatttttaaggatttttagttatttttaggatgggggttggttgtttggaagtggtttttgtttatttttgttgtagtttttattatgaggttagtgtagtaaaataggaggtgtaggtggttggggttaggggttaggttattttttttagtggggtaggagaggggtgagaaaagttggatattgattattttaggttgagggtttgtgtggaggagggggtttatggtaaaggaagtgggaggatgggaaggagtttttgttggatatttttattttgttggttttagttttgtttttgttttatttgtggggagaaagtgaggttttttgttttgttaaattttagtaatgaattttatatttattttattttttgtttattggaaattttttttttattttttggatttgttttgaatagttgggttgtagaagttggtggaatgaaatatgtagggtggtttagaggggattgtgttgaatagtgttgtgtttttgtttatttttttttttgaagataaggtttttttgtttttgttttttttttgggaaagttggagagggggttgaggaaatgggatttattattaatttttttgtgtatgttggtttttagtaggtatttttatattttttaattaggtttgtagggtggaaaggtagttgttgagtttaatttaatttttatttagttgtggaagttagtgtggatggtaaagtatttatgtataaatatatatatgaggttgaggttaagagaatatgtgtttagtttttttttggttttttagtaatgtttttatgttttagttttgttttaagttttaaatggtgtaaggtttttttaggtggaggaatggaagtttttaagaagtttgtgttttagggattatatagaggtagggtttaggagtaaaggtttttagattttgtagtgtggtgttggtaagtttgtgttgttgtatttatattgttttgggatgaaggtgatatgttgattttttttaggtggttgtaggatagttaggaggaggtgagatgttagttaaaggtagttatagataatagtattatggattattagaaatgttatttttgtgttaaagtgtttgttttttttagttgttttattttgtgttaatattttttgggagtgatatgtgtgagattgggttgtgttgatgagtgattattggtatttttagattatattaaggaggggttattttgttgttaattaggtgtagggtaggtggtattggggtatgatgatttgtttggtatggttgttttatttttttttttgtttgagtataggttggtaggtttagaggagaggaggaaatagagttattatggggggtgtgtttaggggtgagttattttaagaagttatagaattagggtatgggagatattgtttagttttgttattaatttgttgtgtgaagttggttaagttattgtatttttttgggttttaggttttgtaattagagggttggttgaagaggtaaatgatagtggttagggatgggggtattgaagttagattttttgtatttggattttttttttgttatgtttagagggaggtttgggtaggttatttaatatttttgggttgtgggttttttattggtgaaatgggaataataatagaattaattttatagtgttgttgggaggattaaaggggatatttattttaggtaaagagtttttaagatagtttggggtttttaggaagtttttgttattattattggatattattatttttgttatggttgttagggttttgtttagtattggtagtttgatgttggtagaggaagggtgaggtttttgtttttttgtagtgttttttttttttttttttttttagttatggtaataatagttgaagtttatttttagttttagtgattggttatttttttgaattaaggattgaaggttttaggtttgttatttaaggtttaggtgtaagaggggtgagttattggtttttgtttttattatatttaggtttttatatgtttttttaaataggtttttgttttatgtgtaagagaagatgttaatttttatgtttggggtgggggtgtttataaatgttttggatgtgagttttgatgggggttatggtgtaggttttgttagggtatttttaattataggggattatttgtagtttatagagggttttttgtaggttaatgggattttgttattttggttgttattttgtttagttatttggtaaggaaaataggttgtagatttagaggtagtatgggtttatatgttagtgagataatataataagggaaggatgtgtaggatgagggagttatggagattttattgtagttttagttatttattagtagattttgtgtggatgttgggtaggttattttattaatttttaggatgtttttgtaggttttgtgggtggatagggtgaatggaggtataaggagggtaagtttgataggggttggggttgggtttggagttagaattttagttagttttgttattgtattttagggtattttttgtagatagtaggttaaagtaaggttgtttagattaaaggggaaggggttttgttttttttattaagggttttttggagattttaatatagatttttagtttatagatattaaatttagggtttttgagaagtgagaaatgtgaaaaatgtatagaatagttgtagtttagtgtttttaatatgttagatttatataggtatatatagtgtttttgtagaggttagaaagttttgtgttgggaagttttttgattgggggaggttttatagtaagtttttttttttgtttatttattaatgggtggaaggttttaattaggattatatgggaagggttagtgggaggggtagagagggaaaatgaataggtaatattaagtgtttggggtggggggtgtaggggatatttaggaggggagggtaggggtgtattttttatttaatttatagggaatgggggtttgggaggtgtaggagaaggttttggtatttttatttttttttttttgtagatttatttatagtttgtttatgggtagttagatttagttataggttagatgtttgttttagttttatttttttggtttattgaaagtaagttaggatagtgagggggatgatgttgttatttttggtatggttatgttgggttttggggtgggtgggaatgtggttggggtgttattttttttggttgttataggtataaaagtttttttgtgttttagtgttatatgtgggttttttttttgttgttttaataggatggatatttaagtagattttgttggttggggggggtttttgtatttagttttattttgatttagtgaattttttttttgttttttggggtaggagttattaggttgggttttaggtaatggttagtgaaggggttgtatggaggggttttttaggtttataggaagggaggttttttttttttgtaatgtggttgtagtattttgtgattgagagggatattatggttggagatggtgggatggaggattttttatagtatttttgatgtttagaatattttattttgtataaaaaagttttaaatttttttgagggttgaagttatttagagttggggtttttgttttttaggttaaaagtattttgttggagtagttgagagtatagtgggaggggaggggtaggagggaatagttttgttatggtgataggggattttttgattttaagagggtttgtagatattattatttatttttagttttgaattgttttttgttaaggggttagaaatttttgggagggggattatagggggttttgtttatgagaatagtgattgtggttaggttatagtttataagttagtaattttgtttagttgttgtggtggtttttttttgatggtttttagaaaaagtgttttattttttgttattagtgttttgaaatttaagaatattttttaaatagtaattgtagtaaaagttaatgttgtgtgagtgttgtaggtattatttttagggttttatatattttttgtttagtttttataaaaattttattttatttttttttttgttttttttttttaatagtttagaaaatgagtatggaagggttaagttggtttgaggaggggttggtggaatagtttgagggtttagtttttaagaattttatattgtaaagggaatttttgggttagggagtagggtatagtttttatttttttatttttgtttttagtattaggtttgatatagatggggttttggttatgaataaatgaataagtgaatgagagtttgttgagggaagaaggtgatagggataagggagaaataaagtagttaatgttgttgtgatgatgatgatgttaatggtagtattgatatgtgggtttttgttatgttaggattgttttaagtattttgttttatgaatatttttgttttttattatgttttgagtggatatttttattagtttattttatagaggggaatatagttgagtgtattggttaaggttatgttgttaggaaaggttagagtttaggtagtatgtggttttttagttgggttttggtttatatggttttataggtagttttatgaaatatgtagagagagtatgtgaggggtttttttgttgttttttatttttagttggggtttattttttgttgaaatttttttaatttgtttttaagttttgttagttatgaaatatttttttgaatatttagtattatttttttatggttatttggttttatttttttatagggtaagttttgggtgaaaagtagaaaggatgaaaatttttgagagaggtgataatgtggtaatttttttttttttttttttttttttgagatagtattttatttttgttgtttaggttggaatgtagtggtatgattttggtttattgtaatttttattttttgggtttaagttatttttttgttttagttttttgaggagttgggagtataggtatgtgttattatattaggttaatttttgtgtttttttgtagagatggagttttgttatgttgtttaggttggttttaaatttgtgggtttaagtaatttgtttgttttagttttttgggattatagatgtgaattattgtgtttggttgaggtggtttttatataaagtagagaaaattatttttagtttaaaataaattaataagtattgagtgtttatgtagaaaaagattagaaggaaatgtgaatatgttaatagtgtttgtttggaggatgtaattattattgattattttttttatattttttaatttaattattttgttataagtaggtgtgatttttaaaattataaaagataaatgttggttttttgtttgtgttttgttttttgagatagggttttattttgttatttaggagttggagtatagtggtgtggttatagtttattgtagttttaaatttttaatttaagtaatttttttatttgagttttttgaggagttgggattataggtaagtgttattatttttagtatttttgttgtttagattggttttgaatgtttggttttaagtgatttttttattgtagttttttaaagttgggattataggtgtgagttattatgtttagtaaagattgttttttaattaggaagatagatgttttttagtattttttgtttttttttttttttttttttttgatatggagtattgttttgttgtttaggttggagtgtagtagtatagttttggtttattgtaatttttgttttttgggtttaagagatttttttgttttagtttttagagtagttgggattataagtgtgtattattatatttggttaatttttgtatttttagtagagatggggttttgttatgttgattagtttggttttgaatttttgattttaagggatttatttgttttggttttttaaagtgttgggattatatgtgtgagttattatttttggtttgttttttagtatttttaatttttgttttttggtattatttggttaagtagatgaaaagttttagtgagttgttagttggtattaggttggggttttttttaggtagttttaagtggttaggatttggttttttttttagagttgggtttagaaattaagattgggaatgtgtgatggttgttttgtgggtttttgttatgaggttatttttttggttttagtgattggttgttggttgtagggagtatgtgggtttagttagggtttgtgttaatatggttttgttttatttatggtttagtgggtttttttattttttgttgtatgataattttaggaaaaatgttaggagggagggagttgttgggggtgtgataggagagattttttagggatagatttgtaaaaattgttttaaagttttttttaaggatttttaaggtttttattgttttttattgataggttatggtttgggtagagaaagttggggatggagttggtggggggagggtggttagtatttgtaaggtaaggagatgagttgggagaataggggttgggagggtagttttaggttagtttttgtttttagaattattgttttttttttttggttataaagtgaggttggttagatataggtttattttataggttgggaggttgggtgtgaaagtattgtgtttgtatggggtattttatggtgaatattattagagttaatttttagggtttgttgttttatagggaagttagtgtaaggtgtttatggaatttagaagtatttaaaggatttgatagttatgagttgggaggatttagttttgtagtaggagaaagagaggtagagagataggttttgtaatatttgttttatttgttgtgttgttttgagtatagtttatttttttgtggttttgagttttagttttgaggtttttaagattttttgggtttttgtagtttaggatgtttatttgaaaattaggtttagttagtagggttttttttgttagtttattattggttagtttttgtttagtattttttagtttattatttttatttgtgtaaattttatattagtattttaagtttttttttttttaggaaggagattgtttttagatgtgttttttgtttttttttgattaaagtttagaaaataggaattagttttgtgttttttttttttattgaattgttggtttttttggatgttttttttgattttttgttaatatttttataatataattagtttttagtttttttttaaatgtaattggtgagtatgttgtagtttaggtggatggtgatgtttttattttgtaatttgtgagagttagtatattttttagttaggtgggttgtaggagttagttgtggtgagggtaggaggtttgtgtgttgatggtattggtattattaaaattatggttagattaaggttatggttaatgagtttttttatttgtaattttttttttattaaggtggttttagttttagttttggttttagttttggttttggttttaggagttgtagatatatttttaagtttttattttaggagtttggttttatatatattggaggatatggagttggggtataaatagttaagaataggtatatttgtaattaggagtagggggtggagggttgttgagatgtttttatttttattggttgttttttttgatggtttattatttattatatattgattgtataattagggttgtgatatgtttgttttttatattatattattaaatttttaaatttgtttttaatttatatatgatgaggtaaatttagagttaataatttgtttattagtttttgaatttatgggtggttttaatttttttttttttagtttttttgggtttatatgagtattgaggtataagggaattttattagttgggaagtgtgttttttttttgttgattttatagtttttttagtttgtgtttgaagttgttaatatttttttatttagtattgttttttgtagtttgagttgttgttgtgtgatttagggttagtgttttaatttttttggattatatttgtaagatgaggatgttgttgtatagtttattttaaatggttattaagttgtttgtatagttaatatttgttgagtttgtgatatgattagttttgttttaattttgaatgtggtatttttatttagtttgggggtggaattgttagtttttttttttttggataaggaagttgaaaggttttagaaggtattaaggttagttgatttgttagtaggtatagtgtttatttgttatttatagtttttttttgattgttttgtttgtttttttagttgagattttgtgtgtatttgaatattttgttaatggttgaatttgtattagggttattgtgttagttgggtttgttaggttattgtttttgagttttgtttaaggtagggttagtgtttatattttgtttttttgttagtgttttatttaaggttttggaaaggttttggagttagagatttggttaaattttggtaatgttttatatttgttgtgtgattatgggttagtgatttagtttttttgtgttttttgggttgttgtgagggttataggagatgtatagagggttttgagtttggtggttggtatgttgtaaaggttagttatgtggtgtaaggatggtattgatgataataaatgaattgaatgaaaattaggttaattgggtttggggaggggtgttggttaaatagatttgagtggattaggattttgtatatgatgagtaagtgggaatagttttaaatagtaagttgggtaggtttaggatgatttagttttgggtgttgtttagggtttttttttggtttttttgttggtttggtttttttttgttttagtttgattgtttttatgggttttaataagtttttgattaggattgaggtagaatagatagggtttaagattttgtaggtaggtatagagtgtggatggtaaaaggagatgttttaggttttttgttgtttttttttttttgaaggttgataatgttaatttatagaagaagttgttttttttggttttggattttattttaatatagtgtatgaggtagttgtgtttaaggggtgtgattatttttgtagatggaatttatttattgtgtttagtttattgttagagtttggaggatgggggaagtgaggtggggtattttttatagtgaagggaaaatttagtttagttatttttttttgtgttgtttttggaatttattttgttatggttttattttaatttagttttttaaagttttagagagttttgtttttttttttgtattttattttgtttatttgtgttgggttagttttttagaagttttgttttttgttatttttagggtattaaggttggttggtgggtttagggatttttattttttgatttagttttagtggtttattttatatttattggtatttataggtgtgttttttatttttggtttttgtataggtggttttatattttgggagtttagttttttttaaggatttatgttagagtatagggatttttgtttttgatttttttttagttttaattatgagtagtttatgttatagtaattttttagttgtttgtagttgtttgttaagttatgataatggtttttgttttttaatttaatgtttgtatatagataaattgttatattttaagtagattagatattattttttttaggaagttttttttgattgttttagttggatagaggttttttttttttgtgtttttttaatgtttaataggtatttattgagtatttgtgatatgtaaggtatttataatataagttagtgttttttgtttttttagagggtatatgaataaataaatggtaagattttttaatatttatttatgttttatagaaagttatttataggtatgggagggttgttttaattgtgggtgatagggaggtttttttaagatggtagtgttttagtaagatttgaatgaggtggttaggaggtttagggagggattttttaggagggaataagtgaatatttttttgtgaggatgagtttttatgttttaggagtagttaggttaggggattggtgtagtgaataggggttgaggggagtggttaggtgatgtagggttttataggttgttttatgatgagttagtgttttaagtatagtagatatttagggaaggtttaggttggggagtgatttgaatagattttttatttaggagtttattggggtttttgggtttatgttgttgtgttattgtatgtttttgggggtttgggggggtattttttatattattattataggtagtatttttgggggaggtgtgttgtgtaggggatttgttggttattttgttgggtaaattataggggattgtgtaggataggtggttagtttaggagggataattatttaagtaggggttagagggtatttggatttgggaggagtgtttaattttttaggtttaggtaattagaggtggggggtggggtgttgttttttgatatgggaggtttgggggtttggttgtattttttggtgtggaggtgttgggaggtgtggaggtttttttttgaggttgggattttttggttattttgatttattgttttgattttattttttagtttgagggtatggtttgaatttatagttgtatatatttttttttgtatagggttttgtggggttggtatagtagttttttttttatagattaggatgtttagttttaggagggttgggattgtttaagattgtataattagggttagatatagttgggttaattttgtgatttttggttttatgtatagattttaagtatataggtaaaattttgttggttgggagggttggggggtagatgagtggggggtagtttttttttagttttttaatatgttaggtttttgggtgggagggggtataaagattttattttttttaagagatagagaaagaggtagtggagggtttttttttggttgaggttttaggttttgagtggtgaatgtaattttatttggaggttggaagttaggtggttttgggggtgtgtgaggtttgttagtttagttgtagttttttttatgtaagggaattttttttaggtagtgtttttatgattagagagggggttaggaagaggtgagggttgtatttagagtgatatttgggtgggttttattttggggatatggttatattttttttttggatttttgaagtttttaggtgtgggttaagggtttttagttgtaggtaggagagggttttatagttatagatttggggagtttagtttgtaaagtttagaggtttttggaggttgttggtttggttttttgtgtagttgggtttttttgggaggtttttttttggtatttttagtttttagtttgtatgattttttatagttgggtttatttttttaggtttgggttatatggtgtaggttagtggggttttgggggagggtagggtgttaggaatagttttgggggtggggggattggagtagagtttattttggttgtttgtttattttgtatgaaggatgttagatttttatatgtggttatttgattttgtttaattatgtgtaagttttggttatttttattttattgatgggaattaaattggttaaggagaagtttagaatttgagtagagtaggggtttaagttttttaggagttttaggtattttttagtttttttttttgagtattgagtttatatatttagtgtttggatgtttatttatttgggggtttggtgattgttagttagtatggtttataaagggtttttgtgtaataggttttatttgatttttttaaaaattttttgaggtaggataatgttatttaatttattttatagataaagtaattgagttataaaatggtttgttaaaagatatagaggtagaaagattaatagtaaagagtttttttgtgattttgattagtaaggtttttagaaaaaagtaagggattttgaggtttttataggaatagagttttggaggagaataagagtttagttttatgttatttttaaggggtattttgaaggttaaggtattgggtttaagtaggttggattgtgttttttgtattttttttattttttgaagtttttttttttttatttaggtgggttgtggaggtgtttataatatataatggaatagttggtaggttattgggttttttattgagttaaggggtttgattagaggtttaaatagtggtatagaaattatgagttttgttgtaaattagtttaggttttggagttaagtagttttgtgtttatagttagggttagttgtttttagttgtgtggtttgaggttagttttttaatttttttgtgttttggtgttttttttgtagtagtaataggaattgttttttatggtgatagtgtagatatattttatgaagtgtataaagttttgagtttagtgtttggagtatgttaggatgtagtaagtggttatttatgatttatgaaatattaataaggtgaggggtggaatgatagtttttttgtgttgtttttaaaatggaaataaatttgtttagtgtttaaagtagtagaaagtgagttaaggataggtttttagtgatatgttttggtagagtgttttttgttggttttaggtagggtttagggtgggtggttattttttagatgagtttattgttggtatttgtttttagagtatatgtttggattttttagatttttttttttttttttttgatttttttttattttgtaatttttattttttgttatttttttatttattttttttttttatttttgtttaaaaataaataatggaggttaaatgtgttagttggttttttggaaaggtttttttgtagtaggaatgtgatgggggtagtggaggattgtttagtgtaagttatgtgatttttgtgtggagttggggaaggggaggtgttgagattgagggtgttaggattgaggtattgagatggggttattggataatggttagggttagtttttgtttttattttaataggggtttttatatttaggggttatatttttaaagttttttggataagagagataaattttattatagggttagaaatgttgtttttaggttgttatttgggtgggggtgagagatgttttgttggtttttaaatatttattttgtggataaaattattaaggggaatttaatgtttttatagtagtttggttaagatataggtattaggttgggtgtagtggtttatgtttgtagttttagtattttgggaggttgaggtgggtggattgtttgaggttaggagtttgagattagtttggttaatatggtgaaattttatttttattaaaaatataaaaattagttaggtgtggtggtgtgagtttgtagttttagttatttaggaggttgagataggagaattgtttgaattttggaggtggaggttgttatgagtggatattatattattgtattttagtttggatgatagagtgagtaagatagttttaagaaaaaaaaagatgtaggtattgttttagggtttataagtataatttgatttttgatgttggtatttaattttgatgtagattttagtaggaaaagggagatgaattagaaggttgtggggatgaggggtttatagtagtgtttattagatttgttttggtaggtataagtgttttttggaggttgttagataagtagagggtttattttagagattttggttttggagggttgggttagggtttaggaagttgtattttggtagggaatttagagttattttgagttttattttggaagtaagagttagggggtagaatagaattggaattaaaagtttttgtgggtttagttttatggggatgggtttggttttatggggatggatttttgtattatttgaggtgattattagtttggttttttgggattagttttgagtgttttttggggaaagtgggatttgtagaggatggttttttaggatttgtttgattatttatttttagtttgtttttattttagtttttttgatttttattttttatttagaattttggagatttggttttggaggtttagagattagaaatgaggggagataaggggagaagtttttttttttatttgttggttatgttaatgggttgattttttaggaagttatattagttattgttattgttttggttgttttgtttggttttgaggttgggtgagtaagtattttgttttgtttgtttttttatttgagttttttgttgatgttatgagaggtttgattatgtgtttaggaggtataggatagagtttagagttgtttaagaatatataaggttgaggtttgggttttgtatttgggaagggttaggaagggttaaaggaaaattttagttgagtataatggtttatgtttggaattttagtattttggtaggttaaggtaggaggattatttaagtttaggagttggagtttagtttgggaaatatagtaagattttatttttataaaaaaaaattaaaattaaaaaattaattaggtatggtggtatatatttgtagttttagttatttggtaggttgagatgggaggattgttgagtttaggaggttgagattatagtgagtgggatattgggttattgaattttagtttgggtgatagagagagattgttttaaaaaaaatttttatattttatggagtttagtagaatttttggttagggtgttttgattgtgaaatgagtgtggtagttgttaatttttgagggtgaagatttatttattagtaatttgtattttggtatggtgagaggaagtgtttggggaaagatgttggttgaggtagagagtttagtttaatttattgtggaggagttattttagttttaaagagaaagattaataaattttaggtgaatggtttaaaagttatttttgtatatgtagagggtgtattttgggatatgtggatatttttttttaggataggaagtaaaattagtaggtagagatgtgagtttttttgtttttgttggagttaatttggagtttttattttggtttttagggaagtatagatttttatttttattgtagttaaaagattttttgttgatttttttagtagtatttagtttagttttgtggggagaggtggtagggggaggagatagagaaagatgagtttttggtagttgtgattggggggagagaaatgtggttttaatttgtttttgtttattttatagatgggtggtgttttattttaaaatttagggtagttgagggattgaaggaagagggggatattttttaattggggtttttttttattttattttatggtgttttatataggaaagagttggaaggttttgggtttttggtatttagttaaagttttaggtaggggtttagatattgggttgtgttattattttaggtagtttgggagttagtgatggtagagttttatttttattttgattattgtatagtattttgtttttaggatagtttagtagttaggttgttttagggtttaaatttagatatttaattgtgggggttttaggtaagtggttgaagttttttgtgttttgattttttaatttggaaaatgggatgatgaaagtaattgttgggtagggtaaggggtaagtgaaagttagtgtttgagagtgatgtggttaggattgttgttgtgattatatattgagttttttttttttatttgagataagggttttattgattgttgttagaaagatttagatttagaaggattaggaaagttgttttatttataattttagagggaaggggaggtttttgtgttagttggttgttgtaggggagagggtgggagatagatgggggatagaggagtaggggtagtaggaggaatggttggtagggaagtttgtttgagatttaaaggattgtttattaggaggatagtttaggttttttttattgagaaagatttttttggatagttgggttgaggatttttaggttttttgggtggagtagaattagttattattgaagttatataggtttgtaagtataagtgggggattgtttaggtatttttgttttataggggttaggtattaaggttagggtggttagaggatatgatgtagtttagtaggggttttgtagaattattagttaagaagatatatgtagaagtatgtaagtgttttgaggaggtaaattttttgttggattgaatatggggagttgagtttttaattattgagttgggttgtttggtttgtttttttttttttgaatagaaggtttttagatagagtagttaggtaatagtatggttaagtaggggtttgtattttagttttgttttgtagtttgattaggttgttgtttttttaggagatatgggattggttagggtttttttaggttgttataggaataaggtagggttgtgattttttttatggtttaggtatttgggggagggattatgagttttagtttaggggatagataggaaatggatagtttgttttttttttaattatggagttggttttttttttattgtattttttttagttatgttttttattagaagattattgtatttaatgggtggttttgtagtgatatttagtttaatgaagttatttggtgggggttttgggggatgtagttttttgaaatatatatgggtagtgggtgagttggaggttgtgtggggttttgttttttggggatggttaggaggtgttttaattatttgtaatttgagtttatagtgattgggatttgttgtttttttattttagtttttttttattagtatttgttaagtgttagttagtaggtgttggtatggtttaaggtaggtttgtagttagattagtattgggggagggattgggagagagatttttagagtggaagttatagttttttttttttttaggttgggtaatagattattatttttagttagttttggggaagggggaggggttagttgggttgtaggtatagtgttggggttttttgaggtggttgttgttgattatggttttttttttttttgggttgggtaatagattattatttttggtttattttagggaagtgggaggggttagttggggtataggtatagtgttggggtttttgtggtggttgttgttgattatgggtttgttattttttttttagttgggttgttattttggttttgaaagtgttttttttagtttttaatttgtgtttaggaggtagttgatattttaagtgttgttatagtaggaggttgggtttgtaagtgtgatttgtttggggaggggtagagggaaagattatttttgtttaaatagtggttttttttttttttttgggggtttttatagggtttttagtttttttttggttaagaggtaaggagaggtaggaaagttttaggaatattggtagagaagagatagggtaggttgttagaggaagtaggttgtagggtgtttaaggttttaggttgggttttgggaggttagggtatgggtaattaggaggtttaggtagggaaatttgttttgtagggattttgggagataggggagaggggatatgatagttgttttttgttgttttttggttgtggtttttaggggttttagtttagattagaagtattttatgtattgggttttggtttagtttggaagtatggtttatagatttatatgattatttgggtagtgatttttaaaaggttttttgttattagttggggagtttttgaggggagggtggttttgtagagtatttggagatattaatgggttgtgaggaaaggaggaggtgtggatatttttatggttttaagagaaaattaaggtagagttggaggttgggtgtggtggtttatatttgtaattttagtattttgggaagttgaggtgggtagattatttgaggttaggagtttaagattagtttggttaatatggtgaaaattggtttttgttaaaaatataaaaattagtttgttatggtgatatgtgtttgtagttttagttatttaggaggttgaggtaggagaattgtttgaatttaggaggtggagattgtagtgagttaagatggtattattgtattttagtttgggtaatagagtaaaattttattttaagaaaaaaaaagagtagagttggaggttaggtggtttttagagtttgataaggaggttgtggggttgggttgtttttttggttatttgaggggtagggattggtttagtttgagttttagatttataagaggttgaattggagtgggattttgagatgaggtagggttattttgtttatatttgtgtttaggttttaatagttattttttttaggaatttagtttgatggttttttaggttgagaggttgttaaggggttgtaaggtgttgtaatgtgtgagttggtgggttttgatgtgtgatagtttggggtattttttttattgttagggaataggaatgaggagttttttatttttagtgtttggtaggtaggaggttgttattggattgtgtgtttaggtgttattagattttgagggtttatggatatggtatatgatttttaatgattaatgtttgtgtagtaggtgttgaggtgttttaattttgagtaaggttgggtttttggaattttttttttggtaggaggatttgtagttgaggaatttttaagaaattttttggtagtaaataaagtatggggttggatggtggatttatgagtgtttttatatgaatgtggatatagatagaaaagatggtaaatatttgtgaataaaaggaatggtttttgtgtattgaatttttatttattggtttttgtttggtataaagtttttaggaattttttaatagttttagttagaaatgtgtttttgtttggttatgtggaaaattttatatatattaagatatatgatgtttttggttttttttatgaatgttttatgttttttgggtttatgatttggaatttgtagatttttgttgtttttgttttagagttataaggattttggatgtaggaaatattttttatgtgtaagggttttttttttttttgttagggtttattggtttttttttgtttataggtgttatttaaatttttgtatttgtggttttttttttttaattattttgtgtaatttgttaatagtttttttatttttagagtttggttgttggagatatataaggtatatagaatttgtgaaatgatattgagtatttattaggtatttattgtgtgttttgtttggtaataataagtaaaattataatgttttgggtatatgagtatatttttttatgtttatttttttagtaatttaatgagatggttttataaatggggaaattgaggatagggaggttagattggtttaaagttataggttaggaggggtagggttaaaatttaaatttagatagtttggtattaaattttagttttttatatgaaaggtattttgtaattttttgagaaggttgggattattatttttattgtatagatgaggaaattaagatgttaaatggttagatagttttggagttaggaggtgggtttagtggtttatgggagtatatggaatggagtttatgggaggtttgaggttgggattttgtattttattttggtttaagggatgaggtgattgggagtgttagagatattttgggattggttatttaggtgttttgtatttagttttagtgttgagtgggtgagggtggataatttgttatttagtagggttgttgtttgtattttggtggttttttaaagtttggttaagtaaagtaagattgtttttggattagagtgatttttaagttatataagtatttagttatgttttggaggatgtaggattgggaaggttttttttttattgtatttttatttagtttttttatggggtagttggttttaggtatagattagatgtttttttttttgtttgttgttggtatgtttttggttttattgttgttttagggaggggtttaagagttttttggttttgttatttattatattttgtttagagggttgggggtttagtattaatgttaagtatttagtagtaaaattatgggttggaaagagttatagtgttgttttgatttggttttattttatattgggtgttgtttttattagtttttttttgtttttggttttattttttaggtattataagttttgtaggtttaaagttaaatttattagtttttgattttttttagttgggattagggtgaggtttttgtttaggtgtaaaagttaaggtagtgttaaaaaatttaggaattaaataatattttgaagtaatattttaaataaattaaattttatgttgaataaattttgatagggttgtgtatgtgtagggttgggtttgttttaatttaaaattttaatatttgtttattatagagattattatgtattattttgatattgaaaaatattgtattaaatattatttgtgttgatttttgagttttttggtgtttttttatattttgtttttgataagtgtttgatatattttgttttagttggttttgttttttaggtgtttttttggggttgttttgtttatgttttttgtagttattaggagttattgagttattgtatttgttttattttgttttttatgtttttgtattgtttattttgttatgttttttttgtgtgttttggttgtatgttagttttagataggagtttggtgggttgggagtttatattaatgttgtttttttttggttttggtgttgggtatagggtagtattggagatttttttttttttttttttttttttttttttgagatatagttttattttgttatttaggttggagtgtagtggtgtaattttggtttattgtaatttttattttttaggtttaagttttgttttttggaattaagtagatttttttgttttagtttattgagtagttgggattataggtatatgttattatatttagttaatttttatatttttagtagagatggggttttgttatgttggttaggttggttttgaatttttgattttaggtgatttgtttgttttaattttttaaagtgttgggattataggtgtgaggtattatgtttggttgagattttttgaataaataaatattattggtatggagatttgtttagggaatttgtttagattttgttattgtatttttgtttgttgtgtttagaggtaatttagggttgttttagttgtttttatttggttattttttggtttttatttaggttggtttgttttattttgtgggttaagaaaatgatttagtgggtggtgattagtattttttttttaatttgaaaagaatatatttattagtggtggtagtaatttaatgttttttagttgatgaaggtaatatgtttgtttataatggaatggtttatgttatggtggaatattatttagggatgtattggtatttgttataatgtggatggattttggaaatatgatattaagtggagaagttagatataaaggttaaatgtgtaattttttgtataagaaatgtttagaattggttaggtgtagtagtttatgtttgtaattttagaattttgggaggttaaggtaggaggattatttgagtttaggagtttaagattagtttgggtaatatggtgaaattttatttttataaaaaatataaaaattagttgggtatggtggtataggtttgtagttttagttatttgggaggttatggtgggaggatggtttgagtttgggaggtggaggttgtagtgagtagagattgagttattgtattttagtttgggtgatagagtgagattttattttaaaaaaaaaaaaaaaaaaaaaaagaatttatatagataggaaggaaatatggaggaggagggtaggattgatagttaaaggttatggggtttttttttaagaaaaaaattttttaaattttttaaatttttaattttttaaaattggttgtggtgatgatggttgtattattttttgaatagattgaaaattatggaattatgtattttaaatgggtggattgggttatgtggtgatttatgtttgtaattttagtattttgggaggttgaggtgggtggattatttgaggttaggagtttgagattagttttaatatggagaaattttgtttttattaaaaatataaaattagttgggtgtagtggtatatgtttgtaattttagttatttgggaggttgaggtaggagaattggttgaatttaggaggtggaggttgtagttagttgagatggtgttattgtattttagtttaggtgataagagtgaaattttgttttaaaaaaataaataaataaataaattggtggattgtatagtagtttatttggattttaataaagttgtttaaaaaaaaatgaaaaaaagttttttttttttttaaaataaataaataaaaagaaaaaaagagagaggggaaaaaaaaaaaaaaaaagaaaatattgagtgtagtatatgtatggtaaaggtaagaattttattatggaaatttggttttattaatatattttatttttatttttattttatatataggtgtgttttggtttgtggtgttaattgtatgtttttttggaggttgtagtttagattggttttgaaagttgttttttgggtaattttaaattttttataatttttgaagtttttggtttgttgggattatttagttttttagatttagttttgttattatttatttaagattgtagttttggggaggggggtttttttttaagggtgtaggggttttgtggttttatttttttttagaatatatattattttgtattgtatatatgtgttttaatatggagtattttaggatgttggttatagttagttatgtttgtatattgattgattgattgtgttttgttgattaattatgttaattattgtgttgtatattgtttttattaagtgagttaaagtaatttttttggaataagttgatggattttaaataagttaaaagatatttttttaggaaaaaaatagtaatgaattttaagaagaaagaaaaatttttaaatttatagatttatggaaaaagtttaagtttttaaagtgttagatttttttaaaagtattaggtttagatggttttatgagtgaatttttgaaaagttttaatagagagattattatgttgttgtttaaaatgttttagaaggtagagggtaaaagaaatgtatttaaattgtttttgttaagttagtataatgtagatattaaaattgataaaaatagtatatatatatatatatatatatatatatatatatgttttatttgttttagattaagtttgttgttgtgtatttaagtaatattatttatttttattttgttgttgaaattaaaatatattttaatggatttatgattttaatatgtaaaaatgaaattatagaagtattagaagaaaatgtgggtgaaatttttttttataattttagaatgtaggagatttttaaataggatgtgaattttaaaagttaaaagggaaagtagagatttgataatattaggattaaaatgttttgtgtagaagaatattttagaaataaaattaaaagtaggtagttggggataagatatttgtatttgttgtgataaagatgtataaataatttttttttttttttagataggattttattttgttatttaggttggagtgtagtggtatgattatagtttatagtagttttaaatttttagatttaaatgatttttttatattagttttttgagtagttgggattataggtgtattattttatttagttaatttttgtagagatgtggttttgttatgttgtttaggttggttttgaatttttaagtttaagtaatttgtttattttagttttttaaagtgttgggattataggtgttagttattatgtttggtttataaagaattttttttaaaaaattttaataagaaaaggatatattttttaaatgaaaagagaatatagggttttggtttataatatatgaagagataattttttttgtttgattgagatgtataaaataaaatattaattggagagtatttggtttttagttaggggtaaggggtataggatttttttgttggattattattgtatagggtttagtagatagttgagtaggttgatgaggggaggggttttaaaaaattttagtaattattttagaggttaatttaggaataaggattaattttttttttttttttttttttttgatagggagttttgttttgttatttaggttggagtgtaatggtatgattttggtttattgtaatttttgtttgttgggtttaagtaagttttttgttttagttttttgagtaattgggattataggtataagttattatgtttagttaatttttgtatttttagtagagatggggttttattatgttggttaggttggttttgaatttttgattttaagtgattagtttgttttggttttttaaagtgttgggattataggtgtgagttattgtgtttagtagattaaaatttaaatgtatatatttttgatatagaaatttattaagagtttattttttagttatgtgtgtatatgtataagtgtgagaatatttgttgtagttttttaattatagtgggaagttggataagtttggtagggttatgggatagttgatgatataattattaaaaggaatgtgttattttgggaggttgaggtgggtggattttaaggttaggagtttaagagtagtttggttaatatggtgaaattttgtttttattaaaaatataaaaattagttaggtgtggtggtaagtatttgtgattttagttatttgggaggttgaggtaggagaattgtttgaaagtggaaggtgaaaggtggaggttatagtgagttatagtgagttgagattgtattattgtattttagtttgggttatgttttgttaaaaaaaaaaaaaaagaaaaagaaaaaggaatgtgttatatttataagtggtaatagtgttgttaaatggaaaaaataaaagttggtagtagaagtttgattttttttgtgtttttgaaaagtttatatttatatattgattttttttatataagttttgaatgattttgtaggaataaaatttaggagaatgttatatttagttgttaatatggttattttttgggagagagttggggaatgggagagaaaaatttttttttaaattttatgtgatttttattttttatttaagaatgattgggtattgttttttttttttttttttagatgggagttttgttttgttgtttaggttggattgtattggtataattttagtttattgtaatttttgttttttgggtttaagtgatttttttgttttagttttttaagtagttgggattataggtgtttgttattatgttttgttgtgtattgttttttaggatgaagaaagggaaaggttatagggagaatgggagttagaatatagagtagggtttttaaatattagtttgtgggtgagagagatatggggtgatattattggtttggaatttagggatggtatgaggtgttgtttaggggttttagataaggtttgtttgttgattaagtaagggttgtgttggtttttgtttatgtgtttgtttaatatgaattttttaggtgttttattttgttttatgaattattattgtttattttaattatgttgtataggaagaattgtgtttatttttataatgagaaaatggattagagaggaaagttattaggtagggtaggggtggtagtttaggtagtgtgagggtaaagttggtgtttttttgttatttttttatatatgagtgggtaaggtattataggagtttatattttaatttttgtgggttattttggaaggtggtagatggaattagtgatttttagggttatttttagttttaggttttagataggggttgtggagtggaattgagtttgatttaggtgtgttgatggtagttatgtaattgtggataaattatttttttttttatttgtattggatgagattgggaatttttattttgggttttttaagagttttggggttttatagagtatatttagtagtagtagtgggatggggggatagggttaggggagttttatgttttttttaattttaattagagtatttttattttaatttttttttgggtttagtgtttagagagaatgggaaggaagtttagttttggttatgggttattttagtttgttagttatagtttatattttaggagttttttttggattgaaggagatagagttatttataatatttatagaaaattttggagaggaagtggagtttaattgaggaagtgtttttttgtagtttttagaaatgaggttataggtgagatagtgtgttagggtggattatatggtatttttttaggttgtttgttggaatttagggtttggttaggggttgtttatattttgggttttgaggtggggagtttgagtgtgtttttttagggttgaatgtgttttttgtttatattgtatagagtatggttgtttggttgtggtgtgtttttttggataggtttgttattgtgtagatttttaattttggtagttgttttgggtttgggaggtggtgggtatagatatagttttttttttttttggtagttgttttgattttttgggataagtgttgagaggtggttttatttagtgttatgtgtttgggggttggggttttattttggggttaggttgggtggttagggttatagagttgtagggggtggagtagagaaattgtttttagtgtttgttttttggttttatttttttttgtagttgtgttttatttaaggtattttatagttgtttggtatttgttgtatttttggattagtttttttttttttttattattgtatggtgtttggtaggttggtgaggggaggggttttttttttgggttttggagttaggttttgttttttggttttattttgttttattatgaaggagatatattgggtttggttaatttttttgtattgatttttgtttttttagtatatgtgggattttttattttagatttaggtttgagaggttttagggatagtttggagaaggagggtatttgtttttagaaggggaaagagaaagagatttaattttaaagtaaaaggggatttgggtgttttttgtaagtagtttaggaaaatgggaggaggtgggagtagtgggattttttgagtaaggtattttggtaggaatgttagtgttttttggatatttttagaagtagaagtatatagttttatagaaaaattttgtaggtttaggatttgaggtatgatatgatttaaatttattgttttattagatattagtgagttttttgatgtttattaaggttttttgttttatatttggtattggatgaatttgtatattttgttttagggagtttatagtttagggataggtttagagtttatgtggggtgttttgtaaatatggggttagaagttgggttgtttatggggttttttttttttaaattatagtggttattttttttttaattttatagtttttgatttttattaggaatttttggggtttagtaggtgttttttttttgtaggttgatgtttgttttttttattttttatttaggtttagttttgattttattttttttaaagttatttttttattgttttgtgttgggtggttttagggagttttgtgttttgattaattttatatttaatgttgtattggtagttttgttgtttgtgttgagatttttttttgttttgtttttggaatatatggtttggtgtggattaagtatgtgaagagttatgtttattattattagtttgggggggtttgattttttgtttttttaatgttttatttatatgataaagatttttagattttttgggttataggaaaattattgagatatgttgttatgtttattttgttttaattttatatttatgtttataagtggttttagaattattgtggattttttttttggtttttggggtgggtggatatatgagagtttagtttttagttatttttgtagatgtttttttgatagattaagaaattgaggttgggaggggtggaatgatagtttagaattagttgatttatggggtagagttgggatatgtttagaattgagttgggtattgggtttggttttttttttgtttttagtgagtattttaagaaggtagagaattagatttatgaatgagtgttgagtatttgttttataaggtagttttggagaaatttggttggtgtggttgaggagttggaggggggtaattttggtggggggggttttgagttagtagttagtttttgtaggtttagtattgggtgttgtagtttagttttattttattttatttagaggtatttatgttggggggtaggaaaagagtagggatttaggagaggaggtaaggttgtttttatttagagtttgagaggattagggatgattttaaaggatgagtgtttttttgtgggaggatagtaaggagggtgttaagtttaggggtagggttagagttttggaaattgagaatttattttattagtataaagtttagattttattaggttttggggtggaggagtaggtagggatgtttttgttttttgtagtgttttttttttttttttttttttttaattatttaggtgtttatatttttttttgaaatgttgattttttttagaatttttatattgaagttaatatttatttattgagttttttagtataatttttagaggagagattaggtgttttgggggtaaagttgattaggaaagtttttgtttggtttttagggatgatttatgggggttattatatttgtttataagaattataaaaaagttattttaatttattattagtggtttatttttttagtataattttatggtatatttattatgtttaagttatttatttggtattttatgggattttttttttttttttttttttttttgagatagggttttattttgttttttaggttggagtgtagtggtataattttagtttattgtagttttaattttttatgtttaggtggtttttttattttaatttttttagtagttgggattataagtgtatgttattatgtttggttaattttttgtattttttgtaaagatagggtttttttatgttgtttaggttagttttaaatttttgggtttaagtaatttgtttgttttggtttttaaagtgttggatttataggtatgagttattgtatttggttttttatgggattttttataaaaattaagataggttgggtatggtggtatgattttagtattttgggaggttagggaagttgaggtgggtgggttatgaggttaggagtttgagattagtttggtttatatggtgaaattttgtttttattaaaaatataaaagttagttaggtgtggtagtttatgtttatagttttagttatttgggaggttgaggtagaagaattgtttgaatttgggaggtagaggttgtagtaagttgagattatgttattgtattttagtttgggtgatagagagagattttattttaaaaaataaaaaataaaaaaaaaatataaaaaaaaataaagataatagttttatttttagaatttagtgggggtatgaaaggaattttgaagattatatagtaaaattttaagtatggatattgttggtttataggtgaattttaggtttttttttatttttgtattttttgtattttaaagaaagggtatttgattattttttatgatttgaaaaattatttttatatttaaaaaaaaaagtttagtagaggaaagaaagtttatatataaattatttatattttaagttaaatatgaggtatttggattaggttttgagggatgtataggagtttattaaggtagtgatgtaaagagaagtagaggttagggtttaggaggttagggtaaaggggttgtgaggaaaggtgtgagagattaagggaagattaaagtaggagaagttgggaaggagagaggtgtgagttgagtaggagagtgaattaattgtggaggggtttatggtgagtgagtagagaaggtttagtatgggaagagattttagtagtgttgtgttttggggaagttagtttgggagtaatttagttggggttttaggagattttgttttgtatttatagttttggggtggagataaattatagtatagatgtttttttgtaggtagaagttaaggggttgggtgtttgtttagagggtatggaattttttttatgatttttttttttatggtgttagttggatttttggtgtttgggggatagaggggttgtagagattggttagagttgtgtatgttggggtttagggaatttttagtttagttttatatggaggggtagaaggggatgggtttgaaggaaagatgggtaggaagttgagttggagagaattggatttgtgtttagaatggttgtgatatagagagggaggatggagaagtaagtaggtggtgttttggaggaagaattagtggggtttaggtttgggttttttgagaagttatttttattggattttaagagtatttttttattgggaaggttttgtttttgtttgtttttgtattttttttatttggatttgtttaggtttttaggattgttagtttagtttatggatttttttatgtgagttggatttttatttgtataggtttttgtttgtgggtggttgggtttgggatgttgatggtttttttttatgttttggttttaatgtgtatattttattttatggagaaagttattgtttttttagagtgttaggtttttggtagttttgaatgttgttgtttttatgtggtttgttttttttttttttttttggtttgatgaaattgtatttttattgttggggaagttttttggatattttttgtgttttagttattttgtttatggtttggtgagttttagaaagtagagtttgtaggttgtgtttttgggtttggtttttggtatagtttttggtataatttaggggttaaattgtgtttgtttttggaggagaatgtttttgtatatttttatggatatttttttatttgttttttagagttaggattatgtttttgtgtatttagtattagttattattgagatttagatggtttggtgataattgtttttttagttatattttgtttgatttagttgagtgtgaatatattaatttaggatgggggtgtatttggtatgttaaataaaggttttgtattaatagaaggtaggggaggaaatagttttttgttattttgtaaattgtttatgtttttggtttgatattatgttattagtaattattgttattgagtttgggtggttggggtagggtggttttttagagttaagtttagagagatgggagagggaatatgggatttgtatattgagggttggaaaggattttttaaggtttattagtttttggttatttagtgtgttttgatgttttttttgtaggaaatgtagagttttaggttttagatttgttaagataaatgtgtattttatatgtttatgaaagtatgaggagtattggtttttttttaaatttatattttttttaggttttatatttttttagtttttaagtttattgattattggagaatttttatttaaaaagaaaaattaaaaaggggttgggtggtttatgtttataattttaatattttgggaggttgaggtaggaggtttatttgaatttaggagtttgagattagtttgggtaatttagtgagaatttgtttttataaaaaaaatttaaaaattagttaggtatggtggtgtgtaatttgtggttttaggtatttgggaggttgaggttggggaattatttgagtttagggggtagaggttgtagtaagtagtgattatattattgtatgttagtttggaggatagagtaagattttgttttaaaaaagttaaagaaaagttaaagaagatggaaagagggatttagagagatgtggaagtaatttaagggtttattgatggaggaatagttatataatataagtgtattgtataatagaatattatttagtttttgaaaggaaggaaattttgttttatgttatagtatgatggatgaatttttaggatgttatgttgagtgaaatgagttagatataaaatgggtagttattgtatttttttatatatataaggtttttagagtggttaaataaatttataataaagatagaaaatagaatggtggttgttagtagttgggggaggggtatggggagtttggtttaatggggatggagtttagtttgggaggatgaaaagggtattggagatggatagtggtggtagttgtgtaatattgtgaatgtattgaatgttgttgaaatgtatattgtaaagtggttaaaattgtatattgtatgttgtgtattttattatggttagaaataagaagtagtagttaaattaaaaatttagattgtgttgtttgtttaatttaaagaaggtttattgagtattattgagttttgattttgtgtttagaattagatttggtttttgaggggtttttaatttagttggtattttattatagttttatggagttatgatttttgttggggttagggggtatgtttttgagaagggatttaattatgttttatagtttggtatttttaaataggttttgtgttttataggattggtattaattttttgtttgtaagttttatgttagtatggttgtgggtttgagtttttttaggatgttgttggagttttatggtttttttttttttgttagaagggtatttttaaataaaattgtgtgtagttattatatagttttttggtttaggtatttttttttagtgttttgagaattttgttttgtaggttaaggtgttttttatgtttttttttttttgttataattattttttttgggggaggaggattagattatgggttttaatgtaagttttaggaggtatatgtttttttttttttttttaagtttttggtttttgttgggtatatttaggtagtttgtaattttttaagtaggagttattagaatgtgatagtttttttaggggttttaattttattttgttttatatttttgtatgagtttgttttggtttttgtgtggttttttattttttaagttttttaggttttttagggatatatagtagatagaggttttagtaaggtttatggtgatttataaaggaggttttttgaaatttagaaaatttttttaaatttttatttaagttttgtttggggtattttggtatgtttttattagatagagagagttattttttttgagtttgtagatttttatttttatgtattttggtttttttgggtttttagggtagtattttttattttatatttagtttttttttttaagattttgtggtaaagttagtaattaggttttttattattatagtatttaagatttagtgttttgtgatttatttttttggttttggggtgtagttttagttatagggggttggggtttgggttttagtttgttttgtagttgagatataggggtaggttttgaattttttaaggtttgggttgggttgggggtggtgggtgttttagtaggtttgggtatttggatttttatttttttgggggttgtgttggtggtaggggtagtgggtattttggggattttggaggtagggggttttattttttggtgggttgatttttggggtttgatgatggtgatttttgttttttgaggggttggttttggtgttttgtggtttaatattttggtttttttgagtttgaattgggatgggttgatggttttggtgttttttatttgtttggatgagatgttaatggatagtttagtgtgttgggatattggtttggttgttttggggtttgagagttttattttttgtagggatgttttgggggagtgttggtttagggagtttatatggtgggttgagggttttgagttttttatgtttaggttttggaatttttgggtggagttggttatagtggtttggagtaggggagtttggattttttggggtggggtggagttgggtgttttgatttttttgattttaaaagatttttttaaggttgaaaaataaagagaggggatgtaattggtgaatggatggttagggaatattttggtatgttttttgttaaggagtagtagaggaaggtaggtgatgtggtggtgagggttgggggtttttttttgttttttatgttttagtaagtggaagggatagttttattttaggagaattattatgagttttggggtagagatgtaggttggagtgggaagatgttgtttgttgtgttttgttatggttatggtgtaaattatatagtttttttttttagttatgtttatataggaatgttttagttttagagaagatttttatttttttttttttttttttgagatggagttttgttttgttgttttggttggagtgtagtggtattttttgggtttaagtgatttttttattttagtttttttagtagttgggattataggtatgggttattatgtttggttaatttttgtatttttagtagagatggggttttattatgttggttagtttggttttggatttttgattttaagtgatttatttgttttggttttttaaagtgttgggattataggtgtgtgttattgtgtttggttttgattttttttttgttgtggttgtttttatttttttttatttttagttaaggtatatattgggatattattagtaaatatatttttattattagttatagtgggggatatgtttttaataataagtgattgtaattgtaattaattagaattgtagtaggaataaaattttattaatgatattaagggtggatattggagtttttagtgttggtgaggtgttgggtttattgagtttattatatttgtagttgtttaattttgggatgtaaagaatattagtatttttagtatagatggggaaagtggggtatggggtagatatagagttagattgtatattaggttgatattagagtttaaggttttaattatttggttgtttggtttttttagtttagtttataggaattaatttttttagttattagttttttttgtatttttttatttattattataagtttgtgtagtgatgttaattattagtttttgttttgtagttattttgtttttttattagggtttgtttttttggaggtagtggggatggtatttgggaagttgttatttttatagtttttataattgtattttaaatgagagttagttgtttttggttattagggttagagtagggagggatttatatggtaggtatatttattagttttttttttaggttagatttatagtgtatttttgtggagatttatagtgtttttttagttgttttttgttttattaggttatagagtttgggttttatgggattttattattgttttttttgtttataggaaaagggatgatagttggtttttagtttttaataatagtgttttaggattaattttagtgttttttttttatttgtttttttttttttaaatgtatttaggtattggggaggggaagaggaagtttaattttttaattttggttgttttagttgttagttttttgggtaaggtatttttgtgggtgttttttttaagttataggtattttttttttttggtggatatagatgaaattttgggttattaagtttaatttttattagaagttgggtaaggagttgtgtggattttagagaatttttagttgttataggttttgttttagttttgttattgttttagaggatatgggtttggtgtggttagagttgtttattttttaagagagtagaaatttggatttttatatgatattttttgatttttaaatgttggtataaagtaaaataagttttttttaaaatattgagtagtttggttgatgtggtgaaattttatttttattaaaaataaaaaattagttgggtatggtgatatttgtttatagttttagttatttaggaggttgaggtaggagaattgtttgaatttgggaggtagaggttgtagagttgagattgtgttattgtatttagtttgattgatagagtgagattttgtttttataaattaaaattaaaaataaaataaaatattgtagggttaaataaaattaaatttataggttgtatttgtttatgggtttagttatgatttttagttgattatgtggttgtagggtagtaggatattgagttttagagttaggggtgtgttaggtgtgggtttttgatatggtgtttttttgtttttttgtattttgtatgtaaattgttggttgtgttttgattttgtagaagttttagggttttaaggaaaggttgaatgtttatttttattagttagaaagtttagggtttaatgtttagaattgaatgtaatgagatgggtttattaagtttattatatttatatttgtttaaatttgggttgtaaagaatattattattgtttttgtatagatggggaaagtgaagtatggggtagatatagagttagattgtatattgggttgatgttagaaagtgtagagtttaatgtttgggtttttgtgtggtttttagggttttttgtggttttttgatttgttttttgttttttgagtattgtttaaattgtttttatatggtgtgtttttgttttatgggtgttgtagagtaggggttggtttttaggtgtttttagtatttttttgtgtggttaagttggagaatagaaattagataggagaaggttttgttttaggtttaatttaagaaaataaatgattttttttgggagatttggtgaattttttttttgggagtttttttggagttatttttattatggttaatttatgattgaagatattgtattaaagtagaggttgttttggtgtgagtttatgattgagtttatggtgtggatgtaatgatttattttagttaggtttatgtgtataagtggattattttagaattggagttggttttttttttagggtattttttttttttttagttgtttgtgtggttggtgttttattattttggttatttgtgtaaaatgtatatgtgtgttggtttttaattattttttttttttttttaatgtttggtgtttttttatggatgggtttttttttttttattagttggtttttgtgtttattgtttggttttatgatttttttgggtgttttggtttagtattatttttatgtttattagtttttagtaagttttgagatagtaggggttgttttatttgtaggggttattttattattaggatggtgttgtttaaaggtgagtttgttttagataatagttaggagattttatagtttttagaattgtaagagaatataattgtgtgttagaagaatagtgagaataggaggtgttttattttggaggtgtttattttttttaggagatgttttattttgggggtgtttattttttttaaggaaattatgttttggttggaatgttaagaaggtgatatttaaatgaagaggtgtttattttggtttatgttatttttttaaatgagtatgttattgtttttttttttttttgggaattttttttaaagttaagtttattttagttttttttttggggagttggttttttatatagtttatattattttttttttatgttattttggttatgttatgattgttgagattggttatgaggggtgtgttttggttttttgggaatagagttgaatgttttttattttatgatattatgtttttattaggttttaggtgtttttagaaaatttattaagttaggtgtggtggtttatgtttgtaattttaatattttgggaagttaaggtggatagattgtttgagtttaggagtttaagataaatttgggtaatatggtaaagttttgattttattaaataatataaaaattggttaggggtggtggtatatgtttgtaattttagttatttgagaggttgaggtgagaggattatttgaggttaggagattaaggttgtagtgagttatgattatattattatattttagtttggatgatagagtgagattttgttttaaaaaaaaaaaataattaaaatttattaaatgttaggtgtggtggtttatgtttgtaattttagtattttgggaggttaaggtaggtttaaggtaggtggattatttgaggttaggagtttgaaattagtttggttaatatggtaaaattttgtttttattaaaaatataaaaaattagttaggtatgggggtgggtgtttgtaattttagttatttggaaggttgaggtagaagaattatttaaatttgggaggtagaggttgtagtgagtttagattgtgttatagtattttagtttgggtgataaagtaagattttattttaaaaaaaaggttggattataggattataggataggtataagttttgagggagtttttaaggaggagggatgtattagatttttatttttattttagtttgtgaagatttatttttgtttgaggttttgtagagggttgattagtgatttttaaaaagatatgtttaatatttaattttaagaatttatgaatgtgattttatttggaaaaagggtttttgtagatgtgattagggattttgggatgagattattttggatttgggatgggttttaaatttagtgtttggtgtttttataggagaaaggtagaaggggatttgggatataaagagatatggtggggagggttatgtgatgagagtagagattgtagatgttgttagagttaaggagtgtttgggttaatgtaagttggaggaggtaaggaagggttttttttttgagttgttggagggagtgtggttttgttaatattttgatgttaaatttgtggtttttagaattatgagtgaattaatttttgttgggttatttggtttttagtaatttgttttagtagttttaggatatttataatgagatttttgggaagatgaaatttttggttgtatagtggtttagggtgaggttagttggtgtggttatttattttttagtttagttttaattttattataattatatttgataaatggtttattgtgggttaatggatatgtggttattttagagttgttatattaggagtttagaggagtgagagttgtttttttttttttttttggagttgtataaaaattttagatggttggagaagttattggaggaattatattattttagatttttgttttattgttgggatatgtggtaatgaaataagattatttttgttagggatgttttatgggtaattgtttttttatggaggatattgtgagttgtatttagttgggaaatattaggagatgtttgttattaggttggtagaatagggttttttagtatttttttttttattagagttttaagattgtgttttgggttttgtagttatatatggttgtttttttttttttaatgtgtaggttttttgggaagttttttgttattatttttatagtggaattggtataatttgtttaggggtagtaggtttttgttattttatatgtttttattttttttgtggagggagatgtagttaaggggtatttatatttatttatagaagtgagagtgtttgtgagtttgttattttgtagattttagaattttgtatgtgattgtatagatttataggtttaattgggtagatttaaaggatttatgtagtagggaggagtattggatagtttttttttttgtttgtaaggagttaatgtaattgaaggatatagaagaggtttttagttgagtattataattgtggattgtgtatagtgttagaaagatgtggagttaggttatgttgggaggatttttatgttgttattggaaggtaaagtagtgttatttttttatttatagagtaggaggtttttatttttgttagttattttttttatttgtgaatttaagttttttaaagttagattttaattttgtaagtttttaaaagtttttttgggttttttttttaatttttattgattttaatttgttttaaaagtttgaagattgtttatgtgttttggtttatttttgggaatttattttaaggaaataattagaagtatagaaagatttatgtatgaggatatttgtattagtattaaattgataaaatttggaaatagtttgggtttttgtagattttttaaatttatatgttaaaggtttgtattattattaaaattatatttttgaagatgagaaatgttgagaatattaagtaaaaatagtaggatataagatgtatataaagattttaattttattttatatatatatgtgtagtttgtatgtatatatatatttatatttgggtagaaaataatgatttttggatggaatgaatggtggtgggtgttgtttattatatttttttgttttttgagatgtttatattatatggggattatttagtatgtttagggaataaaattattgatattgtttttttttttttttttttttgagatagttttgttttgttgtttagattggagtgtagtggtgtaattttggtttattgtaagttttattttttaggtttatgttatttttttgttttagttttttgagtagttgggattataggtgtttggttattatgtttggttaatttttttgtatttttagtagagatatgattttattgtgttagttaggatggttttaatttgttgattttatgatttgtttgttttggttttttaaagtgttgtgattataggtgtgagttattgtatttggttaatattgtttttaaaaaatatattttggtattggttgggtatggtggtttatatttataattttagtattttgggaatttgaggttagaggattgtttgagttaggagtttgagattagtttgggtaaatggtaagattttatgttggaaaaataaaattaaaaaaaaaaaaatatatatatatatagattttgatgttaataagttggagggtgtgggtaattgtatgttggtttatttttatttttatttttggaaaaatattttatagtttaggatgggtatagggttttttttatttttaagtatttatggttttagttgttatataaaaagaggttatagtgggttattttttagatgtaaatttttttttttaggtttatggtggggttgaaataggagtagtttggatttgggtttatttagagaggaatgtgttgtataagggattattgttaaggtttttgttttgattataggttgtttggtaaattgtttttagtttttgaaattagattaagtattttttggtgtatatattaggttttagtttggggagggaatattaagtgagttatagagttttgttttagtttgggataaatgttatgtaaagaaatggtagagtttaaggttagaataattttatgtgtagtttagtttttgtaggagggagtaatgtggtttttgtttagggtagggtggaattttaggtttaggttttaggaatgttagttttggttaaattgggttttttttgagtagtagtaaagtaggttttgtttttgaagaaatattggttatttaggagttagggttagggtttagggaagttggatagatggtgttaaggagtagggaagtatttttttgtatgttattttgagtttgtaggaaaaagttatgggaaaattttatttggtagataattttttataatttttaggatttatagagtgagtttagtagtatgtatgttatgggtatttttttgtttttatttttttgtgatattggattttggtataggtttttgatttgtgtagggtggggtgggtagttaggtagggttttggtgttggtagagtggggtttagttgtaaaggtttttttattttttatttatttaggatttgggggatgaggtttaaaggtttggtgtgtttttaaggagtttaaggattgttttagggttggagataggatgtatgggtttgtatagggattgtgttttttattttagggttgagagtaggagaattaaataggagagtgatataattatagtttattttgagttttagtgtttttagtgttatttgttgtaggaggtgatggggtaataaggtgtttttgaggttaggtgtggtggtttatgtttgtaattttaatattttgggaggttgaggtgggtggattatttgaggttaggagtttgagattagtttgattaaaatggagaaattttatttttattaaaaatataaaaatagttaggtgtggtggtgtatgtttgtaattttagttatttgggaggttgaggtagaatagtttgaatttaggaggtggaggttgtggtgagttgagattgtgttattgtattttattttgggtaataagagtgtaattttattttaaataaaaataaataaataaataaaaaataagattttttgggtgtaggtatggtatgtggtaggggtgattgttgttggtgtaattattattttttgggtgtgtgtttgtgggggttgtgtatgttgaaatgtgtggttattttgttggtgattaaggttgttttggttttattgttattaattatgtttattgattttatatggtttatttttgtgtttttatttagagttttttttagtgtttaagtttttggaaggttggaaggagtgagtagtgtagtttttggttaagaattgaagtataaaaattttagtttttttatttaattttaggtgggataaggttgggggtatggtttgtagtttttttatgttgtttggtatgggggttgggtagttatttgtggttataatgagttggtgaggtattttttattggttggattttttgtttggtttatttttatatttaggtattttttggtgtttttttttattgaaatttttgttttaggatttgtttttggagggatataaattagttttttagaattggtttgggttgtttggtggaggagggaggtggtttttggggtaggtggagtaggttttggatagggaggaggatatagttggggtgatggggaggggtgtgtttttaggaagtaaaattgtttaaaaggaaaggtttaaaaataggtgtagtgaagttgagtggagtttgtaaagggaagttaggaaatagtagtgttagtggagggtggtttttaggttttttatagagagttatatttgtttagggatagggataatgtgaatagaaggtaaagtttatattaaggtggaggaggtgttttttttttagagagttgtagttagatagtttaaatttgttaaaggtttgggagggaagaattagggtattattttatttttagtttaattttttttttagttttttttttttttgtttttttaaggttaggtttggttgggttatagtgttagtagttaagatttgtttttagtgttggtttagtttgtaggaggttagtttggtggttaaaggttattgattgtttaggtttatttgtatatgtggtttaatgattgaggtttgggatttggggttattatttatagtatttttggataaggaggaaaagaattatttttattaatttttggatggaggtgtagggagtgttaatagtatttttgaaaattttaaatgtattaggggggttagtatttagggaagagttataggaggttattttgatggattttgatgattatttttgtttaagtgttaggaggaggtttttttttttttgtttttggtaattttgggtttaagaagttttaggtattttggaggttttttttgtttattatagttttatttaagaggtttggtttattttgtaatgatgatgtgagaatgagtaggtttgtttagtgttagagtttgtggttggatttttggttgaggttaagagaaataaataagttttttttttttttttgtatgttataggaagagtagtttgttggttgtaaggggattttttattttgtttatggggtatagtagtttatagtattttttttagaaatggagtattggtaggtttgggtttttgtaagatggaatataaaggggtgggtagttgattttaatagttagtttttgggattttaaatttttttttattttttaattttgtgatgttaatttttttttggataaagttttttaataatttggtaagttagtattagttgaattagttttagtttgaattagtagttttttttagtttagttatagttttatttttttagaagggaaaagaagttttatggatttttttataaggaatttttagaatttgttatggtgtttgtaggggatattggtattaattttgggtttattaaatgtagtgggtttaatagtgttttttaaaatgatatgttttaagttttaatttttggaatttgtgaatatgattatatttggaaaatggatttttgtagatgtaattaaggtaagggttttaaggtgagattattttgaatttagtgggttttaaatttaatggtgagtatttttataaaagatagaaaaggagaaagatatatagatagggggagaaagttatgtggagataggggttagagattagagatgatggtgatgtgtttgtaggttaaggaatgttaggaatttttaggagttgttggaagttatgtttgtaagtttttaggttgtggtattttgttatagtaattttaggatatagattttaggaatagaatatagaaaagaaatgggaggaggtttagagtttgttgtggttattttagttattttatttgatttttttagtgttttgttaattttgaagttttttttagttattgagttattggttttgaaaaggagatatgggtgttttggagttggtttagtttggtaggaggtagttttgttttattgtttttttattagttattagtttatataggttttttatagtgggtaagtgtgttgttgttttagtttttgttggttttttttttgtttggttttattagttgtagagttttttgttgttgttttttttggtttaagaggtttatatatttagtttttttgggataaatttagtttatatttgttgttttattgtagttatttaagggttttttttattaatgtgttttttaagggatagtaagttatatggttgttttatttggggttagaattgtgttttattagagtaaggttttggagtaattatatttagggttagggagttatttgtttaagaatagaaatgtgtggttgggtgtggtggtttatgtttgtaattttagtattttgggaggtagaggtgggtagattatgaggttaggagattgagattattttggttaatatagtgaaattttgtttttattaaaaatataaaaaattagttgggtgtggtggtgggtgtttgtagttttagttatttgggaggttgaggtaggagaatggtgtgaatttgggaggtggagtttgtagtgagttgagattgtgttattgtattttagtttgggtgatagagtgagattttgttttaaaaaaaaaaaaaaaaagtgaaatgtgtagttttttttttttttatttttgaaatatgaaggggaggtgattgtaggttttttgggaaagatttttttattttttttttttttttttttttttaagatggagttttgttttgttgtttaggttgtggtgtagtggtgttatttttgtttattgtaagttttgttttttgggtttatgttatttttttgtttttgttttttgagtagttgggattatgggtgtttgtttgggatagttatgtagtagtttttgttttaagttatttttttttatgtagagtagaattaggattatagtaaaggttttagaggaggttattgtttatagggttttgggttttttttttgaaaggtagtttagtttttaagagggtaatagtgattgatttgggatgaaggtttttttgtgtttgtttttgttatttattgtgtgtttttggttttggtagttatagggttattttaggtggattttaaagtggtgttaagttgttggatttttttttttttttattaaattagttatgggaatgggagtatttttggtatatttttagatgtgttgtattggtttagtgttttttttatttttgggttttaaattagttgttggttgttttattaggagtagattgaggggaaatgggtggaagttgtaggggaagagatgtgaggtagataaagaggaagaattttttggttggggtggggttgttagggtttgggtgggagggttgtttattttttgtttttggtggaaggtagtagaagggtgggatggatttgtgtgggagggtttaggtgtggtttgtttgggggtaggagagggattagatgattttttaggtttttttgggttaaagattttttgataaatggttgttgttgaaggtaggagtgaggttttgggaggtgattgattttgaaaaattataggttgtagttttgagggttttaaaggttaagtatggagttttttaaaatgaggttttttttagttttaatttatttatgttttttaggtggttttagatattttgttagggtttttttggtagttttttgtttttgattttggagatagagaaatgtgatgttggtttttggtttgtttatagtttttttgtttttattatagggttgttagttatttttttagtttattgtgtgttttttttttttttttatttttgattttttaataatagtagatttttttttaaatatttttttgtttagattttgggttttatgtatgttgtttttagaaatgtattttagttttttgtgaggagttagtaaggttgtttggtgtttttttttatggatgggaagttttgttggggattaggatttggatttggagattttgaggagtgtgttggttagtgtttgttttgaggtttgggatagagttgttaggtataggtagtattggtgtgagggtttagttttttggataagtttttttttgtttgtttttagatttgttattgtatatataggtggtgattatttttgatttgtttgggtagagaagttatttttttttttttttttgttttattgtttattaggggaaatgttataagtatttaaaaaatgtaaaaaaaaaaaaaaaaaaaaaaaagtgtttaatattaggggttatttggtttaggtggagtttttattaattatggggttttttgtgttgtggttttaaggtgggtagttgatggtttttgtttgagttaatatgagttgtagtttaattataggggatggtgattttagggagtagagtttaggttttggttatagttgtatttaggagttagttgttttttagatttgtagagttaggggagaggtttggaggattggtattgaatgatatgatttaaagtgtgttaagttgggttggaggtgatggtagagttatagtggttatagagtttttatgtgaatttatatggatttgtttggtttaggttttgttgaattttagggtgaggaggatttggtttttatttttaaagatatgaagaggttgataaagaagagttataggtaaaagggggtggtgggtgtgttgtgtaggaggggttgtaattggatgtagaagattttagaaggggtaattagagagaggtagtatttttagaagatgggttgtttggttgttttaaatagtttagggtgtgattgaggggatttttggatttagttggggttttttttgttttgagataatgtattgggaaattttattaagtttatttaagaatttgaaaagttttttggaaatttagtgggtagggtgggtttttgggaggatttttggtatattgtgagagttagatatagtgagggggttttatatttttgtttagaagttttatggtagaggggtagaagtttagggaggagtaggtgttgagattagaggggtttataagagaggggtttggggtagggggtagttgttgagaagtttaggaaatggtgtttgtttttggggaagtgaagttttgggaatagggttggtgaaggggggtgggaagggggaggtgggggtggagggttaggttagattaggtattttttttagtagtagatttatgagtttttggaatttgtttatagaagtgataagtgttttgtttttagttttgtttatatatttatttattaagtgtggtagggatagttgttttttattatttattttgggatttggatttaagtggaggtttttggaggggtagatttaggggaaagggtttttttagaagtagttgttatttagaggatttgagatgagaattttattatgtttttattagatagaggagatttgtggtgtttttgagtttggttttttattttttatttagtagtgttttttttgtttattttaagtttagaatattttgttttttttaagattagttgttgtagtggattgaatagtgatttttaaaagatatgttagagttttagtttttggatttgtgaatgtgataggagttggaatagggtttttgtagatgtaataaaggattttaagaggagagtattttggatttagggtgggttttaaatgtaatgataagtatttttatgagatatagagatatagagaaaaggttatgtgaagatggagtagggagtggtgtgatgtatttatatgtttaggagtatttgggagttattagaagttgggagagaggtttgggttggagttttttgtagaggttttaaaggattagtttggttgatattttgattttggatttttggtttttagaattatttttagtttttaaagtttgtggggttttgttgtagtagttttagtaaattgttatgggggttttttttttttgttaagtttggtatttaaagttttttagttatttggggttaattatattgattttgggatttttaggttatttgtgtgttttatttttttgtttaatttttagtgtttgtgtggttatagttttttttttgtgatatgagttttttgggtttttgagtgtttatttgttttgtattgaaggttgaagttaaattttggagagaattgattttttttgtgggtagggtaggtattgtgtttttagtatagttagagggtattggttgaaatgtgtttttgtaaagtgttttttttatgtttgtattttttttttaagtggggaagttagagaggtttttttgattttttttttagttttttggggtaggaagtttgtggttatttgtttgtaaggattaggtggatagataattagttttttttaggttatattttattaatagagggttttttaattttgttggtggtttatgagagaaggaaaaattgaaggagttgtttatagtaaattttaaatttttgtgttagagaggtttatggttgagtaaggtatttttatttttattgttttgagttgttaatttagtttagtttagtattgtgatttttgatttgtttgtgggttatgggagtttggtttgttaattagtattttttagatatttattttgtgaagtttttagtggttgagtgtttttttgttttttttggatagtgtgggttataggggatattgggtaggaagatagttaagtttttattgtttagaaattgtttgggtttattgtagtaatagggatttatttattagtatgaggtttttttgtaggaggggtgggggtaggagggagtttgtggggtatagggttgtaggaggagttatttttttttttattaaattgtaggttttagttaagttatttttagtatggttgtttgtgtgggaagtttatagttgagggattgtttgtatgtggtatgtaggagttataagtgttatttatattttattttgggttaggtagatgatttttttggttttagttttttgatgaggaataggaagggttggattgaaagattttttttagtttggatatggaatgattttatgagggttatggtgaggtttgttttagttttgtatattagtttgggttagtagtttttaaaggtatagttgtaggggttttggagtagggataaggaggattagtttattttatttttttgggtagaggttaaggattttgtttttggtttatattttttgtggttaaaaatgtagaagtaagtagtgttggtagaggtatttagatttttgggtaaagtaggggttttatttgatattttaggtttggagtatgagaaaattagtttaggttttaggttttttgattgttagtgattagggaatgtgatattttttggtttttgtttttttattttttaattttagggggagattaggttgggtgatgtgtttttttttttgatagtaaatttttatttatttttatttttatttttgttttaagagggggttttttatggttgggtgtagtggtttatgtttgtaattttggaattttgggaggttgagatggatggattatttgaggataggagtttgagattagtttggttaatatggtgaaattttgtttttattaaaaaatatgtgagttggtaattttaagtttttagtagtttttgaatggaggttttttttttgtaggatttttaaattttataaatatgagtgtttgtaatttagttatttaggaggttgaggtatgagaattatttgaatttgggaggtagaggttgtagtgaattaagaatgtgttattgttattttagtttgggatatagtgaaattttgttaaaaaaaaaaaaaaaaaaaggtgggggtttttttatgttgtttaggttggttttaaatttttgggtttaaggaatttttttgttttagttttttagagtgttgggattatgggtatgagtttatgaattttaaaaaataatatttattgttttgtttttgattgtaaaaggaatttaggtataaagttgaaaatttgtaaaatgtataaaaataaagggaaaaaatttataaatttataatttaggtaatttttattaatattttgataaatgtttttttattttttattggggagtgtgtgtgtgtgtgtgtgtgtgtgtgtgtgtgtgtgtgtgtgtgtttaaataggtttatatagtgatgatgttgggtgtttttttttatgtggtgttatgtggttgaggtttttatatattttgggtttgtttttttgatttttttgtagttttgatgttttgattttagatatgttatttttggtttggattgtttaggagaattatttttggattttgttaaaaaatggattgttggtttttaatttttggtggttttggtttaggagggttgggtaagtttgggtattttggagtgtttttggggtgttgtaggtgtgaatttttgtttttttgaagatttataagttttattttttttatttttttttttttttttgagaattttataagaggaaagtttttatttggaggttgttagggatttggagttgttagtttatagttttattttgtttttatttttttgggagttatttaaggataatgtttagttttagttgttaagttttagttttagggttagttatatattgaaggatatgtagaagttgttgtgtgttgggtattgttgaggataaaggtttgaatgataagtgggaataaagttataaggttttaaaatttgtttgaggttttatagttagggttttggaaatttatgaaaaaagttagtttaatattttgttatggaatataggtaggagagggagtagtttttagttagtttttagttagttttttgttagtttttttgtgaattattttattttgggttatagttagggtagttgttgtttttttttttgtttgatagtttttgagggtaggagttagtttgtttattattgttttttttttattagggtttggtattttgtttggtatgtagtagaagtttaagaagggtttattgtgtttattttgtaatagttaatgtgtatgagtgtttattatatttgaagatagtgatttatttttgtttttattgtatagatgggaaattgaggtattgagaggttgatgatttttttatattgttgtgtgggtaagggtaaggttagatgtgagttggtatgttgggttattgtgttttttgtttatattttgttttgggtttgggaaggttatttttggagatttttatgatgttgatattttgtttagtttttttgtgtatttttttttatgttttttagttatttaaagtattagttaggtagtattgttattttggttttgtaaatttagttattgagtggaagagtagttaggttgaagtggggtagaggtagtttttgttagattttagggttgggatttttagttatttttattttttaaggattagtagatagagatttttattgtgtttagttaggggttagggaataggtttttatagtgggggagtgatggatggatgtaggtgtggattgggaggatttgggttggttttttagtgttggagttttagtagtttaatttattttgttgggtttttgtggggattaaaagatattttgtatataaagtattagtttagggtttggtatttaggaggtgtttaattaaaggaaatggttatgaaaaataataaggagaagtttagttataggaggtgtttgtgggtaaggagagaatagttggaagggtttggatttgggttagagataaagaatgtaagagggagggagggagagaaggagggagggagagaaagagggagggaaagaaagagggagggagagagggagggtagggtaggtaatagttggttttagggtagttgtgtgtaggagtttgttttattatttaaatattaggagagatgtaaatatttgagtgaggtttttttagtttggttttgttgtggttatagttagggttggagaaagagttttttttttattagggtttttgttttgtgttttttattttagttgttttaagattttatgtttttgggttaggagtaggggtttgagagtagtaattaggtagggtagtggggttagggagggattttgtttttgtttttattttttttttttgtttttgtttttatttttttttttttgtatagtattgggtttgtaaaggtgtgaatgaaggatttttttttttatttgattttaaggggtttaggtggttaagggttttttttgtagtttagaaaaaaaagtaaagtagttttttttgaggttttttggtggaggtttagggtttaaagtttgttgttataaatttgtagttttttttgtttttttaatagtgttttttttttatttgggttattttattattttggttttttttagttttttaggttttttggggaggaggatagatgtagagtttggattttgtgtgtagtagggtttttttaatgttgtggtgtattttgtttggttgtgggagtttgttttatgttatgatttgtgttggtattaatagtttttttttttattttttatttgagtgttgagggtagttgtgttaggtatagatatatagttttttatatatattatgagtttgtagaaatggtaagagaaggttgagtgtagtggtttatatttgtaattttagtattttgggaagttaaggtgggtggattatttgaggtaaggagtttgagattagtttggttaataggatgaaattttgtttttattaaaaatataaaaaattagttgggtgtggtggtgtgtgtttggagttttagttatttaggaggttgaggtaggagaattgtttgaatttaggaggtggaggatgtagtgagttgagattatgttattgtattgtagtttgggtaataagagtgaaattttgttttaaaaaaaaagaaagaaagaaaaagaaaaaaagaaaaggaaaatggtaagagaagttggttagtattatttgtttggtaaatttttattttggtttttggttaggaagtttttttttaggaagtttttttgttttatttttttttttgagtttatgtttagatttttagtgtttagaatagagttggtttttggggtatttatggatggttgttggataaataaataagttaattgttttttttatttttagtgatgtttttggtttggtagggtatttagtagtaatgttttttgagtggattttaaggagtattttttattgtgtagtttgtattagggattttagttttttattttaaattaaaggaaaaaatttaattttagtaaatatatagagtattttattttttgatttttaatggggggtaagaggtagaggatagaggagaagattatttttttaggtttggtttggagttaaaaagatttgtatgtttttattgtagataatattggtttttgggggatatagggtaggggtttggtttgttttttgtagggaaattgtttatttatgtggaaagtggggttaagggtttttgtttggaattagttttttgtatatggggtggggggtggggatagaaggagattttgtttggattgtatggaaatttattagattgttggttgttgatttggtaggagtagagttatttttattttttagggttttgtttgggggaggggagaggttaggtggttttgtttaggttatattttttatggttaggaatgttttttttttattagaaagaaagatgagataggtttattttgaattttttggatataggaagggggtttatttgtggtttaggtggtttttttttttatatttaaggggttttataaggaggtgttaggatttttaggttttgttttagggaattgttgtttgtaaaggttataggtagagatagttaggaatgttttttatgttattggttatgggttggaggttgtgaaattaggtatagaattagaaagatttgttataggttgtaaagggttttagagagttttagttttttagaggggtagtattgtagaaggggtgagaaggaaaaattagtttttaggaattgtttatttagagtttatataatatttaggtggtatgagataatggtttattttttattttatttttttgttgttttttaagatttgagtttttgggggtgtttttagtagatagggggatgtggggtaattgtttttttttaattgtatatttggaggtaatttatatttagatgatttttttgaggttgtgattagagtttggggtaggggaggggaagtgggtggatgggaaggtgagggagatttttttaggaaagttgttttaggtgtttgtaaggttttattgtttatatttaaggtataggtttttggttttgaggatataggaaatttgatgttatgtggggaggagggtattgtaatgtatttaaggttaggttttttgattttttggatattggataaatgatggtttttttagttggtttagagatgttaggagtgatagaatgttaaaggttgtagggggatatttagaaatttttgagaaagaagatggataaggaaaaataaaaaaatatgagaagtttagtagagtttgagttttgtatttttggttttttttatggttatgggtaattttttggagatttagttatgggagtagtggaggtaggtatgggtgggggggggggtgggttttattgtttatggttttggttgatattgaggttatttttttgtttttttaagtttttgggtattggtaggatttttaaaaatgataataaatttgaagtttttagaattgtttgttggtttagtttaaatggagttttggggttttgtagattaaattaaatagtttgagtttagaaatgttttaggtgtttgggggtgtttaggggttaattggtgggtttgtttggttggagagatgataaatttttttatttttgggattgtgttttagagagttttggattttttggttttataagtaatttagagtttttaaatttgggaaaaattaagagggttttggaaagaaaggtagtgtttgattatttttttttagtggttttgttaagggagagtataggaatttggtttttggttgggtttttgggatgaattaaaataaaaagaaaaagttgggggagggggtggtggaattgtttggggttttagtttaggttatatattaaggagattttagaggagtaggttagttttatttttggtatgatgatggatgggtatttggttggttggtaaagggaagagatggtaatagtgaggttttgaatttagtggttaagatttatttttgagtgtgattttttttgatgtttgggtatgtaagaaatgggaggtggagaaaggaggaggagattttagttttgtttttttggtattaggttattagggaatagtattttttttttaatgggtaggtagaggttataggttgttaggttgagaagtttttggtttttatagataaatgtatagtttgtatatttgtattattttgggtgatgtttattatgtatggttattatgtatgttttttattattaagatagttgatgagattaggtggttattgtgtattgggtattgtggtgattgtttgatattgatttttgggggtttaggtttttggtgggtttgtttttttaggtatttagttttttttttattttttgatattttgggtttagtgtaggggtatgggggtgtttagtggatgggtttatgggttgggtaagtagtatgtagttttggtttattagtttttggttttattattagataagatgagattgttttagttgttagtttagttttgtattatatttgattgggtttttgtagaggtttgttggatgagaatgtttagggtagtaggtattattttttgggatgtatattttgttataattgttttttagggaaaggttagtttgtagagttgaatgtaggttgttagtgtttttgttgtttttatggtttggttatttagtaagtgtttattttattgttagtgtttggttttgtagatgggtatatggtttatttatttgtgatattttagggtgggggtgggggtagatggtggtagggaagattaggataattttttagtaagaggaatttgtagttaatatgatgttagtttttagaatgttagttaggtaggaaaaggggggttttatggttgtattgggagtttgagtatttgttgggtttagagggatttttaggtgggtgttattggtattagtgtttgttgtgttttttataattagtggtgattatgttgtttggttttatttatatagtggtattatataggtttttgtttgagattttttatttttagatttgtatatttaagtatttaaatttatttgttttttgtaaatgttttttttttttgtttagatgttatattagttgtgatatttattatatttgtaggaggtaggatttgtgtttagtgttatgggttgtattttagagttttttagtaatttttaaagagagttgtttttaattttattttgtaggtagggaaataggtgaagaaattgaagaaattgaagttgtttagttttttaatggtagagtgagggtggtttgggtatttttatattgttatattttttatttttttaaagtattgtttttttggatgtaaattttgtttattagttttatttaaaatttttttggatagttatagtttatagaaagtatttttagtttgtagttatttagttattgtaggggtgttttggtgtttatttttatttgtttttttttggatatttagtttagagaatttatagttttgttgtaaggttgattatagtgtatttgttgtttgggtgttgtgtttgtttttttttaaatgaattaatttgtagttgggatagtgggtttgtttggttttgggttttgaatttaaagagtattaagttagtgttgttagtggttgtgggatttgtgtaagaggtttgtttttattttttatggtttttgttttttattataaaagtttaaattgtagagaggtagtatttataggatgttttgagttttggttgaaaggtagggtttattatgtaagaggtttattggtattaattagggataggtttgtatttattattaagtaatggggtttttttttttagagaggaaagaggtatttgaattttgttagtgtgttagtttttatgttttggaggtgttgggatttttagataagaaggtatatttatatggttttttttatttagaagtttgttttatagtttgttttgtttttagaatatagatttgggggttttttttgggtgatagtgggggtttgggagaagtttagatgttatatagttttgggatttgagtatgtgggttttgggttagattgttttaataaatattaaggatttttggatttttttttggtgtgtaaatttggttatagtaaatattgttgagtaaagtaggttaatagttggtatttggaaaggtttttgttatataaagatttgagttgtaattgtgtttgtgataatagatttggtttgaatttatgaaagtatatgttgtttgttagttttgtgtttttattaattagaagggagaaagaggaaagggttattttttttgttattttattatgggtagtggtgggtgttgtagttgtttggaggtttgtttgtatagtggaaaagtagaaaatgagattttaaaaattttattagttaaatataaaatattttttttgttgttatgtggtggtttttatagagttttaaaattttgaagtttggagatttattttgaagggggagtaaaggtgggatgtgggaagtttgagtttatggaagatattgatattttttttatttttgggaattttgagtttgaaggatttggtttgaatagtggaaggattgaatttttgtgtaatttattggtgatggaatataaagttatggtgtttttggtttttaagatgggagggatggggaaggttttgggtgaaggggataggtggggaaggaaaaggtgaagagaaaggtgttttttagggagggggtagatgtgtttaggatatgggatattggtagaattttaattttgagtatatatataggtttatggatggttttttgtttatttgttttttatgggtgtgttgtgttggtttgggtatttgtttttttttttatgttaggttatttgttgtttattttgtatattgttattagttttaagttttttagaatattttgattagggttttgtggtttttgttataggattttaggtttagatgtttgtttgattggaaaattgtttttagagatgttgtggtttagagtttgttttgttttggggtggtttttggagtttttgttttttagtaatttatatggtgataggtatttatatttgttggttttaggaattttggggttattattttagtgttgtaaggagttggtagttttttttttatttttttggtttattttgtaggaattaagatattaggtgagttgttttgggaaagagatttgtgtttttatggtgttgtttttgtgtttatttttagttattttagatgttttttgtggattagttgtatttttggtgggtatgtttggttttttgtagtttggtttatatgatttttataggtaggtttttttttatgttttagttttttttttagttagtttattttagttttttttattgttgttggttgttgttggttagaaggttttttttttttttgtaatttaatttttatttttttttaaggtttgttttttttatattgattttttttttgttagttagtggtgatttttttttattttgatttggaagttgtttgtttatattatttttggttgggttgaattatatttttttttttattttttttaattattttttttttatgtttgtttgtttatttaaggttgtttaatttttatatatatatttttatattttttaattatattttaggttttttgggtattagggagggttatttttttatattttaggttagtttttatgtatatgtgtatttatgtatatatatatttttttatgtttattgatttgggttatttgatggttttaagattagaatttttagtaaaattatttaggatatataagggggagattgataaatatagggaattagtagattgaggttttattttttgagattgagaaatttttttttagagttaaaggattgttaattgttgtattaggatggttttaatgagtttattgttttggattaaattatagggttataaaattggtttgggagatagttgtagaagtagttttagatggaggtatatgggggtaagggtggagttatatttagagatttaaggaaggggtattaataatttttatagtgtaaatggtgatagttgtataatgaatataattttaaattttggtttttttttttgttatagggtttttgttgagatatgagagtttttttttagaaattttattgggggtttgatattttttgttaggaattgagagtagagattttgattttgtaggtaggaggagagttttgtataatatagggtttttttttataagggtttattggaaagtggttagattggttaagttgtgttatttggatatttgggataaggaaggtttttggaggagtggttgtagggaggagttgtaaagaggtaggggtagggaggttatatttatttggggattgtaggaggtttaatggaatatagtggatttagggagattttagtatgagtatgtgtttaaagatgtttagatgaggaggtgttgtgggggaggggggtgggaatagtaagtttttttagttttgtagatttagattttttttttttttgggaagtagggatgtaaagggatagagtttgaaaaagggtttttattattaagttgataaagtaattatgatgtttttagtttatattttgtatagtgttagtggttattggattataatttttttttgtttttttgttgttttatattttttttaggtttagttttgaagaatagttattggtattttgtttggtgtttagttaaagttttggttttttaggaggttttgttttttttatttagatagggttgattttaggtgggttgtgtgggtagttgggtttaggatatttagatgttagttttggttttggttatggagtggggaggattttaggttggttattttttagtttggtttgatatttggatagtttgtttattttaatatagttttttttttttttggtttattagagggttttgtttaagttagtttaggagtttttttgaggggtgggggttttaggttttggtagaggtaggtttgttttttagaagttttgttttagagtgttggagattattgtgtgagttttttttttgtttgttgtatttatttttgtggatgtaggatgtagagttttagtattggtagttaagaggatgtaggaaagtgtatgtatttataggtttagagatgtggatgttagatttaggtttggatagagtagttttgtaagttttaatatattttgtaaattttgaagataggagagagttaaaatattttttttgtttgtatgtaggttttttttgttttttatggtttgattttgggaggtggatgaggatatttttaggtttggatgggggttatgggatattttattttagattttgttatgatttgggttgtgtttgtttggtgtttttggtttatgggttgtataatttggtggttttgaaattggtgtgggggaggggagggttgtttatttgagtaggatgtggttgtttatttagttggaggtgaggaatgatttttttattttgttgttgggtttaagtggggtttgagagttgttggggagagttaaagggaggggattgatggattttttagagtgaaattgtgtgttttggagagttttgaggtagttttgtgagtttttgaggaggttgttgttgtttggtaaatataaataataataaaaggaaggaaatttaggtggtagtgtgtagaatgagtatagggttttgtgagggtgtgtagggtttatgtgggtgtttttaatagggttttttatgtaggtggtgtgggtatggggttgggggtgtgtggtgtttttagtgggagggtgtttggattaggggttttgtttttttttagtgtatttttgtttttttttagtgtatttttgttttgtgttaggtttatttgtagggttttttttagtatgtttgtggttgtagtagttagtttagtatttatttttgaagtttgaaatgattttatttagttgtgtgttgattgtggggtttgatatgatggttggtgggtagtgggttgtgtggagggtagtggtgaggaagtgtttttggtggggtttgggttttgtgtgttggttggggtgttgtgtttgtgtttttgtagtgtagagttagttgttggaggagtttttaggttttttggtttagttgaatgaatgggggaggaaggtgggtgttggtttttttttgtgtgttgtgtttttgttttgtttttgttttttgggtggattaggtttttgtatttgtattggtttttttgttttgtattggttgttttgtttgtttgttaaggttaggtttggggggttggggtttgagtggttgttgggggatagttttgggtatatgattggagtgttttttttttttttgtttggtttgtgtttaggggatggtgagagatgtggttttagtttttttttttgggtgttttgttgtggttagatgtgggtggatgtggaggttgggttatggtgaggagggtgggtgtttagaggggaagagatttttttttttttttgggtgtagggtttttttgtaggaggttgtatttgggtagttaaataaagttttttgttattgttgttgtgtgttttgtgtttgtaagggttaaatggtagtgtatgtggttggtaggtaggattttggtttgtgggtttaagagttgaggggtgtagggtgaatatgtgagttttatggtattagtgagaggttattaatttttatttattgagggtatttttgtagttaatatttttattatgattattgttttgggggttattgttgtatttttttgggtgagttttggagaaggtattgtttgggagaaggggtatagggtggggatggaatatggttgttagagaagttagggatgggtgatgtttttttttttttataataagggttttttgagagtaggaagtagattttgttaggagtagatgtttttgaaggaaggtgtgaaggaaggagttaggtagtgagtgagtagaaagggagttgttttaagggttttttttttttttttgggttttaatttgaggtttagttttttttttaggttagtggtttttatttttaaattatattatttataaggtaggtagggttgaggggttggggtagatttggggatttgggttagatatagaatttgagaagtaataggtttttatttttaagaagggttttttaggtttgttatttataagagagagaggtgttttttttatttgttttggaaagttagaaatttatttttgtatgttttttttgttattttgttttttagatttttggtttttgtttagagttaggggttatgtgagaatttatagtatggaataatatttttatttttgaagtagtaggttgtaatgttataattgtattttggttttttgaatgtgtggttggggagtgtttgatagtttattttgggtttgaggttgtttgttgtttatttgtttttttttattttttttgaaatattttaaatgtgtaggagtgttgagattttttagttattttggagaggtggggggtagggggttttttgtggaaaatgttttaggtttgggtggttttttaagtagatgaaattaagttttttttttttaagaaaagtaggtatttttttttttatgttttggatattttgaattatttttaattaagtgagtttgtggatatgggaattgtaaaattatagatattttagatgtgtgtatatttttgttggtttgggagtttgggttttagaaatgtagttattgttgttattaatagtattttgtattttttatgttaggttagggtatgttttgtttgaattttagtatttgggtttattggatagtttagtttttattgggttatttgtttatgttgtatttggggatttgggggtttagtatttaagaaatttagtttaataatatagtttttttgggaagatgttgggtttggtataatagttattttaagttatagtattatttttgagtgtttttttaaaaagtatttggtgagtgtggatatatttatgtaattgtttttttttagggttggtatggagttttattagattagtatagggttagttaattgtatattttttatttttatgtatagtgtagtaaatatatttagttttttggggagtgttgttagggtgtatgttttattaaaatgggaatttaagggataatggtaggagagtagttagaaagtgtgtatgtttttgtgattgtgtttagagtttattggttttagttttagttattgtttttttaatgtaattatttagagttatatgattaggtttagaaatttttaggtaaggaggttttttgagtttttttaggaaatttaaattagggtttggttatatttttagttaggaagtttatttttgtatttaattaattgttttaattgtatattatttattttttttttttttttgtttttagaggagatgggaaatagttgggtattattttttaagttataattattttttttatatttaaggataatttagttgttttttggtttttttttttttagtttaaattatttttttttagttttttaattatattttgagttgttttttgattatagttaagggttgggtttagtttggggttttaggattttaatgaggttttattgttataggatagtgaggaggttttttattttttttttttagggttttagggtttggatatatagttttagaaggggtattgggtagagaagatgtatgttggtagtagagaggaaattgagttgaaatttggtaagaataaaagaattataaaggtttgtgtatttagtaaggtgtatttttttatggttataaaagaaggtaagattgattgtaggtttggttaaagggattgtttgtgtttttagtgtataatgagatttatagtgggttggtgattttttttaaaataaagatatgtttatttggaattttaaatgtgatttgattttgtttaagggtttttgtagaaagaatttaggtaaggattttaagataaggtgggttttaaatttaatgttgtgtttttttaagagatagaaaagaaagtatagagatatagaaaaaggttttgtgaagatagaggtagagattggagtgatgtagttataggttaaggaatatttggggttattagaagttggaagaggtaaagaaaggtttttttttggagtttttagaggaagttggttttgttggtattttgattttagatttttggtttttagaattgtgagaggatatattttttttgttataagttatttagttttgatagttgttatagtagttaggagaaatttgtgttttatttttatttgtattatgttttgaggttaaagttttatatagtaaagatgtttaagtaattataaattttgtgggtagtttatttgtttagtagattattgttttaagggaagggggatggggatagggaagagagttataggaaatttttgtatgtttttttggaaatgggaaggagtaggtttggagagaaattttataggttaggttttggggaaatgaagtttataaagtgtgggaatggagtggggaggaaatttatgaggaagtagtgtttggtgtatatatttatatttatgatttttttttaggtatagtttttatggagaggtttagttggtagggaagtaaaagaggtttggagagtgaaggaaggtgaggggtttttttttagtaatattgaggttttagatgggatattttattaggtggtaggttgtgtttttatagatagagattttttaagggtagggtttagatggttttatttttgtgtggtttgatataaagtaggttttttagagttgttgagttttgggtttgttagtggtagagttttttatagttttttaagtttttatagttttttattttaggaaatggtgttattatttatttagttgtttaagttaagtttttgggtattattgttgattttttttttttttttatttttagtatttaaattatggtgtgtttttatttttagtttttttgtgaattagtttgaattttttttttttagtagtgtgttagttaatggttaataattggttatttggggttagtaaaagtaataatatttagttttttgatttgtagtgtttgtttatttttgtggtgttaatatttttgttttggttaattttttttttttttttttttttttgatagggttttattttgttatttggtttggagtgtagtggggtaattttggtttattgtaaattttattttttaggtttaagtgatttttttgttttagttttttaagtagtttggattataggtatttgttattatttttggttaatttttgtatttttattagagatgaggatttattttgttggttaggttggttttgaatttagatgatttgtttgttttggttttttaaagtgttgggattataggtatgagttattgtgtttagttggttaattttaagttatttgtatgatattattggaggtgagattgagaagagatgtttagttattatgaatatagtgtttttattatataaatataattttaagaatataattgtaataggatagataatagttaaatgttgtaaaaaatttaagaggtgatgaaagttgtgtatttattattttttgttttaaatataattatttataagtaattttttaatgttttgtttaattttttttttataatttgtaatttaatttatattgtaaaaatttattatttttttaatagagtaatgtatttttattgtgataaaatatatgtaatataaaatttattatttttggttagttattatggtttatgtttgtaattttagtattttggaaggttaaggtgggtggattatttgaggttaggagtttaagattagtttggttaatatggtgaaattttgtttttattaaaaatataaaaattagttgggtgtggtggtaaatgtttataattttagttttttgggaggttgaggtatgagaattgtttgaatttgggaggtggaggttatagtgagttaagattatgttagtgtattttagtttgggtgatagagtgagattttgttttaaaaaaaaaaaaaataaaaataaaaaagataaatttattattttaattaagtttttatgttagtgatattaagtatatttatattgtatatttattaatattatttatttttgaaattttttttaattttttaaattgaaattttgtttttattaaataataattttttattttttttttttttagttgttggtaattgttattttaatttttttatgaatttgattttatataagtgaaattatataatatttgtttttgtgagataggtttatgtagtatgaggtttttaaggtttattatttaaggtttatatgtagtgatagaattttgttttttttgaaggttgaatgatattttattgtgtgtatatatattttgtatatttattttttttatatttgagtaattgagagtaaagttgttataaatatgggtgtgtaaatatttgtttaagtttttgtttttattattttattattattattttatttattattagtattattattattttagatagttttattttgttgtttgggttgtagtgtagtggtgtgattttggtttattgtaatttttgttttttagattggagtaatttttttgttttagttttttgagtagttgggattataggtatttgttattatgtttggttaatttttgtttttttagtagagatggggttttattgtgttggttagggtagttttgaatttttggttttaagtgatttattttttttagttttttaaagtgttgggattatagatgtgagttattgtgtttagttattattttagttttaaatattatagtaatttttttattgttttatgagattttttgagatagtggttttagggattttatatatatttgtttgattttgtgtaatgataaagtgtagttttttttgtagaatggtagagttgggagatttttgatggggtatgagtttaaaggggtagaggggatgtttagaatatatatggattttttatgtgtgttttgttagttattaagtagatttgttttagttttgatatgtttaggattatagatagtgtatggtttttatttgggttaagtttttggaattttttttttttttatattatttgtattgggagtagttattaggttgtggattattaagttttttttaggttatttgagtttgtatttttttatttagtttgattgagttggtgtgtagttattatattttattatattttttgtttggttgttttaatgtaattataaggttttatttaaagaagtatatgattaatttgttttttagattttttagtgatttttttagtttgttttgtgtagaatatttatagtaaaatttgattatagtggtttgagtttttatttttaaggtaggggattttttaaataaagtattagtgttttaaatttatgattttttaaggaggtttttggtttttagtatagtaaatgttttgttttatggttttttggttttttatttttattttatttgagttttttgttttggtatttgggattgaattagtttggagttttttagttttgttgtttgttggttttgatgatattattagggattgtagtattgtttggattttttgttgttatattttattgtaataatatttaatttgatggaattttgggagtaagtggtaggggtagggatggtggtggttaggggttgtatatatataggatagaaggattgaaggattgggtggaaagtatgatttttttaagatgatttttttttagtagaattttggttgtgttttttgaatagtatttgtttatttgtatatttggtgagttttgtgattagtaaatttagatgtttgggaggttattagtggttttgttgaggtataatttagatatgatagtttatgttttttttttgatttttttttttttatatagttttatgattagagtgttttttttatttttgtttttattttagttttgtaagatatagttgtgaaatggttaaagtttttaattttttagtatttgtttgagattggagtataaaaatgagatggggatatagtattttatggatattagtgatggaaaaaaattttttgatttttttgggagttttgtaaagttatattaggggataagaaggagtggttagtttggtattgatttagttttaaagtagttagtgattaaagtatatagttggtatttttttatttttagggtattaggaggtttggttagaatttatgttagttaggagaaataggttgtttttggggtttttggtgttttggtttttttattgtttttttgaagaaggtattttgttttgtggggtttgaggttggaggtaatttgttattgatgtagtgtagggatgagggttgagttattagtttgttttagttttatgttagtaggaataatagggatttaagtagagaagaaagtatttatttttaaagttattatagtgattgaggtgatgtggtttttagggagtttttttttttgttggttttttgtggattgtggttttatgttttaataatgtttttgtttattttgtaaggtttagtaggtggaaggaaagagggtggaggttgggagtggtggtttggtaatttgggaagggtagggagtaggaatatgtttttttttttttgtatttgtttagaaggttttatagggtttgttttgttatttataattttagggagatttttttttaatgtttgttttataaatgtttatttattttatatttgaatatttttagttatagggagtttagtatttatttatgttatttattttatttttggttgtttaaaaaagaggaaagagagagaaagaaaagataggaaagatagagaaagggggaaagagagagagaggaaagaaagaaagaggaaagaataagataggaaggaaagaaaaaggaagggaatggaagggaaggaagagagggaagaaagagagaaagagagagaaagaggtataaataaggtaggttttatggagtagagatttaataagggagtaaaatatatttgtagttaggttgtagatggatttttataggagtgtatatttattttattttttttggaatagaaaagtggaaagaagatgtagtggtgtgggtgggtggtggttttttttgggggtttggaatgtggggtattagtttttttggttttgagaaggagattaagattattaatatttatagtggagattgaattatataagggttggggatattgttttttttgtatttttaataaagatttgatgttttaattatgggaatttgtggaagaagaaataaaattggttttggggttttttagagaattggttttttatttagtggtggttgtgaagaaatttttggagttagttttagtggtttgggtttgtatagttgagattgtttttggaagttgagtggaagtggggagtttttaggtatagttgggttttgttttttattttagttagtagttttaggatttttgggtgttttagagttttttttagagggtaaatttagagtatgagggagtggggagatgtttaatattgggggatttttgtttgtttttgtttttagttttgttgatttgaatagggaggttatgggtgtttaggggtagaattgtgggttggtaagtttttagttttggtttttttttgtttttttttttttattgttattgattatttttggttatatgttgatatttttataggatgatggagaagagagaagaggaatttttttgttttgtttagtatattttaaagaggttttagtgtaaaggtattgatgtttatagttaaatgtgtgtgggggttttttaggagtgggatgtttttattttgttttagattgttatgaattgatagaaggttttatgttattaaatatattttattaataaattattttaatatttagtaaaaaaataaataaaaatgtatgtattttgtgttttgtagtgtttttatgttgtatttttttttgtatttgagttttggtttgtgtttttggtttgttgttttgggaatagaatgttttgtgtgggaggtagataggaagtgtggggtgtgttggttgggtttttttagataatttggtattgttttttttagataatgaaattttttttattttgagtgtttttggaagttagttggtagttagattaatttaaatgaattatttgttttttttgtgaagtgattttagggatttaatgggtttgttattaatatagttttttttgtattttgttttttttttttatttttttttttttgtatgagttattggttatgatgatttggtttagttaagggatttggttagttttggttaggttatgtgagagatagtataaaggattaaggttgttggaattaggttagaggttgagggttatatggattttttggagtgtttgtaattggggatttttaaggttgttttttggttttggggatttgtttatttggggatagttttaagggagatttttaaaagtagggagttaaaagggtgaattaatatagaaatattgagggttagggagaatttgaagatgggtttggttgggtatagtggtttatgtttgtaattttagtattttgggaggttaaggtgggtggattatttgaggttaggaatttgagattagtttggttaatatggtgaaatattatttttattaaaaatataaaaattagttgggtgtggtggtaggtgtttgtaattttagttatttaggaggttgaggtaggaggattgtttgaatgtaggaggtagaggtggtagtgagttaagattatattattgtattttagtttgggtaatagagtgagattttattttaaaaaaaaaaaaaaaaaaaaaaaaaagataggtttaaggtttggagagttagaagttatttttttatttttgggtggtttattttgagattgtattatgttagagaaagttgtgggagtgtttgtttataatttataagtaatattgttttttttttttattagtttttggttttagtaggtttttgatttgtgttttttttagggttttgggtttttttaagttggatttttggttgttggtgggatgattatgtgatttgttatttttttgtttattgttttgggtagtttttgttatttggtgtatatagagtggagtttagtaaggttggggttgttgattttttgttagttatatttgtttttttttatgttatttttttttgttttggttatgtttaggggtttatatttttttataagttaggtgttagatttttgtgtttgttttattttgttttttttgtttggtgggttttttatattttttttggtttgatttaggtttgatttgtttttaggttttagtttagaggttgttttttttaggaagtttttttgggattgttagatgaagggatttttttttggattttttttttatttttatagttttaggaatagtttttaatttaggttttattgagttagtgtggtatttaggagagttataagtgtgtgatgaatgtgttgaagtttttttaaaagttgaaggagttttgtgaatatatagtagtattagtttagattgtgaaggtataggggagttagttttttttagttttgtttgtttttggttttttttttgaggaggtgggagttagttagttgggattaggaggtgggttttatggagtagagatttaataagggaataaaataaattagagaatttttttgttgtaaggaatttagataaggagtatttagttagaggaggaaggaagagattggtagtagattttttttgttttagtagttttgtaagttagatgggttaattttttagtatagttgttttttagtatagagaaattttttatttttagtaatagggtgggaatatttttagatagggttatggttattttggttatagggattatggagtttgagtttttgtggtttgttttatttatgtggttatagattttgagtatatatttggagttatagagtttaaagggtagggtagggtagggaatttgtttgattggtgaaggttattttattatttggagtataggtttttgtttttaaatttatatggagtttttgatatggggtattgattttaaggaggtgaatgtggatatttaaggttagtgaatggttaggtgttaatatattgataggtttttggttttttttttaatattgagggtaggaaataaatggggtttatatggtgtatatggtttttagagttagtaaggtgtgtaagatttggtagttgagaaaattgattatttggttgggtgtggtggtttatgtttgtaattttagtattttgggaggttgaggtgggtggattatgaggttaagagattgagattattttggttaatatggtgaaattttgtttttattaaaaatataaaaaattagttggatgtggtggtaggtgtttgtagttttagttattttggaggttgaggtgggagaatggtgtgaatttgggaggtggagtttgtagtgagttgagatagtgttattgtattttagtttgggtgaaagagtgagattttattttaaaaaaaaaaagaaaagaaaagaaaagaaaattgattatttgattatgaataagttagaatatttatttagaaaaaaaaaatagttttgtttaattggggatttaaaattttaggatttatgttttttttttatagagttatattatttttttaatgtttatttttgattttatttgtttgttaagttttaggtatttagaatatagtatgatagtaagttttgtgatttttataggtttttttaatttattttaggtatagttatatttttagttttgagtagtagggagtgatatgtagatggttatttagatagagaaagatttttaaaaggagggtaggttttgttttgtaggtagtatttattgatatagatattagtaggtaaattttttaggaagatttttattaagaaagaatgaaagaggtttagtgtggtggtttatgtttgtaattttagtattttgggaggttaaggtgggtggattattttaggtaaggagtttgatattagtttggttaatgtggtgaaattttatttttattaaaaatataaaatttagttggatgtggtggtgggtatttgtaattttagttatttgggaggttgaggtaggagaattatttgattttaggaggtagaggttgtagtgagttaggattatattattgtattttagtttggggggtaatagagagagattttgttttaaaaaaaaaaaaaaaaaaaaaaaggatgaaagataaataaggttgaaattggtaggttggtatatttttaataatttattttaggttgggtgtagtggtataatgttagtattttgggaggttgaggagggtagattgtgaggttaggagattgagattattttggttaatatggtgaaattttgtttttattaaaaatataaaaaattagttgggtgtggtggtgggtgtttgtagttttagttattttggaagtttaggtaggagaatggtgtgaattagggaggtggagtttgtagtgagtggagattgtattattttatgttagtttgggtgatagagtgagattttgttttaaaaaaaaaaagaaataaaaaataaaaataataaaaaaaaaataatttattttagtagggagtaggaggtaaggtttgatatgtagtgtttgttaatttttgtggtgtaaatatatttattgtggtaaattttaagttataaataggatattattaaatatagagttgggaaaagatatgtatattattggataaaatgtttaggtagttatggtttatttttttttgggaaggggggtatgtttagaatgttttttattatggagaatgattgtggtaaatagggtttaattggtaggttgatttaattaattgtttattgatgtgatgtggggtaggtttttgaggttgtttttatgtttagggaagaaggtggttatgtggttatagatttggttttgggtttgttttttttttttttttttgagatagagttttgttttttttttttaggttggagtgtaatggtgtgattttggtttattgtaatttttgttttttgggtttaagtaatttttttgttttagttttttaagtagttgggattataggtgtttattattatgtttagttaattttgtatttgtagtatagatggggttgttggttaggttagttttaaatttttgattttaggtgatttatttattttggttttttaaagtgttaggattataggtatgagttattgtgtttatttgggtttgttattttgaggatatatttggagttatgtgtttatgattttttttttattttaaaattttgattttattttattgtttttagagataggttttgttttgttatttaggttggagtgtagtggtgtaattatagtttattgtagttttgaatttttaggtttaagtgatttttttattttagttttttgagtagttggggttgggtttataggtgttattatatttagttatattttatatttttttgtagagatagggttttgtaatttgtttaaattggttttaaatttttggttttaagtaatttttttatttttagttttataaagtgttgggattatagatgttagttagtgtatttagtagttattatgattgattggtgatgtttgttttagttttaggatgaaagagtagtagtattttagttaagtatttgtggtttttgattggaagatgttttttttgttttttaagtatagtgtaaatgttatttttttggtaagtttttttttaattttattttttttttggtatagggtttgttatagttttgtttatataaagagagttattagtgtatgtggtatagatgttagttgtttttttaatatttgagtttttttttttttatagtaattgaagttttggttgtgtatagggaagtttagttgaagaatatattgtttagtttttttgatgataggagtggttatataattgggttttggttagtgggaaggagttgaagtgtttaatttttaggttatgtttttaaaaataaagagggatatttgttttttttttttttttttttttttttttttttggttggagtgtagatatgatggtaggagttggaattattttagtttaagagatggaagttgtgtgttgaggatgtattaaaggaatgaattaggtttgggttgttttgggtttttataatgattgatatttggattgggatgtgggtttgagtgttgtttagtttttgatgttttagtttttgttatatagttagatggtgttttgattaatttaaggtatggttattattttatttgtttggtagggtaggggttttatttttatatgttgagtttttggtagaatttggtgtaatatatatagttaaagtaaaatgaataggttattttaattaaggtttattttgtgggttggttttggtatttggttttaatttttattttattttatttatttattatttttgagatagagttttatatttgttgtttagtttagagaggagtggtgtgattttggtttattgtaatttttattttttaggtttaagtgatttttgtgttttagtagttgggtagttgggttttttttgagtagttgggattataggtgtatgttattatgtttggttaatttttgtattttttgtagagatggggttttattatgttggttaggttggttttgaatttttgattttaagtgatttatttgttttggttttttaaagtgttgggattataggtatgagttattgtgtttagttagttttggtatttggaattggaaaataatagtttgagttttagaggggataaatataaatatgaggtagaaggaatagtaagtaaatatgtgtttagagtaggttgggttgtttatatttttaaaatattgttaggtgttgaggtttgggttttgtgttagatttttgggtgtagattttgtggggatatttattgggtagtgggatttttggtaagttatattatttttttgagtttttgttgattaagttgtttattgagaataatatttagattgaaaggatttataataatatgtgaaaagtgtttggtttaaaataggagtttggtaattggtagtttttattatttataatatatagtttaatgtttttgttttataggaatgaaaataggatttagataggtaaaatgatttgttgagggttgtatagtgttaatgatagagttaggattagggtttggggttttgattttttttgtagtattttggttttgtgagaagtggttttgggtgaatataaggagtgaggagttggtgagaaattttgaaaatgaagttgggtgtggtggtggatgtttgtggttttagttatttaggaggttgaggtaggaggattgtttgagtttgggagttggaggttgtagtgtgttatgattgtattattgtattttagtttaggtgatttagtaagattttattttagaaaaggaaaggaaaggagaggggaggggaagggagggaatttttgatagtgattttagagataattaggatgatttgaaattattttgaaatgtattaaaaaataaaaataaaatggatttatggttaggtgaaggagggatagatggatggtgaggtgataaagtaggtgtagtttggtgttagtggtagaatttaggtgatggttgaatgtgttttttgtaaaatgtttttaatttgattatgtgttttgaatatttttataatagaatggagggaagagaaaggtaagagggagttattgtagttgttgtagtaggagtagattttaaaatattatgtattagatttttagttttgtttttgtggatgtgtttttgtttttttttttgggatttaaggatatttaatgagtgtatgtgtttttaagtttttttgtttttttatttgtttttatatttggaagattttataggtggtgtgggttagttttttattttgttttttgtgtttttagtgtatgatagatattgagtgagtgttagtttttttttttgatattttgtttgtttgtttagagaggtttttttatagtttagttattaggttgatgtttttggatgtttggttgatagtttttttagttgtgttttagtgatttggtaggtgttttgagttataaataaggttattagtggatgtttttaaagttttttttattatggtgttttttttttttttattaatagtttgttatgatagttagtttgtatgagtttttttttagggttgtgttttttgaggttgtttagtgtttggtttgttagagtttattagatagggtgtttattttttttaggtttgagtttttatttagagaattatttatagaaggataatggagaaaggtagttggggtattaaatggagtgtgtttgtatgtggggggggaggggagggggagggaaagtaggaagagaagatataagaggagaaataagaataagaggaaatatagaaggaggaggagtagttttttttatgggggtggattttgtgtttagttttttattaaggatattatatttattattttgtttggtttttatgaatatttttaaggttgtttttttttggtttttatttttttattaggaagtggaggtatagagtgagaaagagttgtttaaggtttttaggtagtttatggagttattgggagttatatttaatttgtttaattttatgtttttgtttttagttattataataaattattaaggttttatagttataggagtttagtttggagtttttattgggttttttaaggtagggagatggggttggaggttatgttaggtgtatggtgtttagagttgtttaggaagttttgtggtgtgggttgggtattaggtagtgtttgtaggatggagaaatgaatgaggttgagatatagtgttgttttttttaaatgtgattttttttgagtttttgtgattggttatttgagagggtagttttggttttttggtgtttatgtttgggtttagagatgttttttttagttaggtttttttttgaggatggaaatttagaattttattataggaggaagagttgggagtattttattttttttttttttttgagatggagttttgttttgttgtttaggttggagtgtagtgatgtgattttggtttattgtaagttttgttttttgggtttatgttatttttttgttttagttttttgagtagttgggattataggtatttgttattatgtttggttaattttttgtatttttagtagagatggggttttattgtgttagttaggatggttttgattttttgattttgtgatttgtttattttggttttttaaagtgttgggattataggtgtgagttattgtgtttggttagggagtatttttaagatttttgtggagggttgtttaggtttaagttttttattatggaaggttttttagatgtggtagttatggtgtatgggttgagggtttttatttattaagaagtaggagtatttgatgtatatttagtttatgatttttatttatttgggggttgtgtttgtagttatgtgatataagggaatagttatagtagtgggttataaagagagtgtgggttaatgtgtaggggtagaattttgatagttttttatgggttggtagtagggaggggtatatttgtataaattttatatgtatagttttttatatatatgtggttgataattatttatatatttaagatgggatttggtgtatagtttattagtaataggtgttggtaatttttagttgtttttttgttgtggtgtagatattatttaaggtgggatggagagagttattgtttttaaggttatatattttaaagggagatgttgggttatggaatgaaaataggaggattagttagagttattggttttgagttatataatgggatatataggtttatttattttatatttttattgagtaattataatgagttaagttgtatagattatttaaataattggtatgtagaaaagtattttaatttttttttggttttgatgtgatgggaagaatttggatttttggagttatagagttggatggaaattttggtttagttaattattggttgggggagtttgggtaagtgatttaaggtttttgagtttgtttttttgtaaaagagtagtgtttgggtttgttatgttaggttagggtaagatgattgaagagtaagtgtttagtattggttaggggttaatgtttttaaggatgtaaagtgtaataagtaggtgttatgattgtattgttttttattgtttgtggtaaatatataagtaaagatggttttgtgtttgtgttgggggaggtagggaattggttttaggaggatgttggtttttttagttgttttttttaaagttttttgggaggagaaatgatttattttagttgttgggagttttaatttataagtaggtttgtttatttggtagtggttgtatgtaggtaggaggggttttggtagtttttaagagtgaggggttgtttagtttttttttagttggaaaggaggttttaggttgggtaggagtatttggggaaatttagtttttggagttaggttatattagggagatgaggttgttagaagtttttttggtgtttatagtaaaatataattaaagtgggatttagattttaattagtttaaggtttgatttatattagagggaaattagtgtttgttgtatgagtgagtgtttatgtgtgtgtaaggtagagatagattttgggtaagtttttttatttttttatgtttgtttttttatttataaaatggggtaatattatttattttatagggttgttatgaaataaatatgtattaatatttgtaaagtgttgagaatagtatttggtataaaataagagtgatagatttgttaaataagtaaaaaataagatataagtttaaagtagagtttggtatattgtgagtattaagagttgtgttttttgattttttttttttgtggagatttttttattagaagtgggagggattgttgaggttggagttttgttttagggatttttgtggggagttttttagtttagagggatttgttttatggattatatttgttttgggtttttgtgtttttgtgtatgtgtgtatatatgtgtgtatatatatgtaatgtgtgtgtgtgtatttttatggatttgtgataatttgtatatatatgtttagaatttatttgatatagtgttttattaagatgttggagttttgatgaatggattgtggggttgagatattgtttttataggaagttgttttagtagtaagttttttggtttttatagataattaaaaagaatggagtttgtttttattttttgttttaaaaatgatgtatagtgtgtggggtttgatgttggaggtttttttagtagatatatttttaataatattatattttgaaatttaagttgttgtaaaataagataagtaaagatggtattggtagggatttttgaggttttttttatgtatttttgaataatttttatatggtttttgtttgaatgtttttaggtatggggaatttattattttgtgaaatagtttgttttattgtttttaagtgaatattgtgagaaaaatatttttttttgtaaagagttaagttttatttgttagtattttttaggtatttggtattagttttatattttgggggaatttaaaataaatgttttttttttattagataatttattaattatttggagatagtggttgtagttttttgttttatgtagttattttatttagtttttttttggaatttttgatgtgaatataagtttttttgttatgtaggttttttttttgggttttttatttatttgtgtatattttggagaggttgtttgttttgtgggtgagatttattgtgggttgaattgtgtttttttaaaagatatatgtaagttttgattttttagtatttatgaatgtgattttatatggatatagggtttttgaagatgtaattgggttatttgagggtatattgaattagagtgggttttaaatttaatgataggtgtttttataagatagaggtaggttgggtatagtagtttatgtttttaattttagtgttttgggaggtaaagttttattgtttgagtgtaggagtttgagattagtttgggtttttgtttttataaaaaaattaaaaaattagttaggtatggtggtgtgtgtttgtgttttagttatttggaaggttgaggtgggaggattgtttgagtttgggaggttgaggttgtagtgagttatgattatgttattgtattttagtttggaggatagaatgagaatttgtttttaaaaataaattaaaaagataatagagagggtagtttggatagagatataagaagagatatagggtgaaggttaggtggggggtaggttgagttgtaagttgaggaatattaggggttgttggttgttgtagagtttggagaaaggtatgggatagttttttttggaatttttaggaggaatgaatttttagatattttggtttgggatttttggttttagaaattttagggaagatattttggatgtttttgtttttgtttttgtttttgtttttgagatggagttttgttttgttatttaggttggagtgtaatggtgtgattttggtttattgtaatttttatttttaaggtttatgttatttttttgttttagttttttgagtagttgggattataggtatttattattatgtttggttaattttttttttttttttgtatttttagtagagatggggttttattatgttagttaggatggttttgattttttgattttgtgatttaattgttttggttttttaaagtgttgggattataggtatgagttattgtatgtggttgattttggatgttttgagttattttatttgtggttttttgttatgatagttgtaggatagtaatatagggttttagtagggtggtttggtaagggttttttttttatggtagtttttattttgttttatttgtagggttatttagatgtttattttggttttggttagtaagtgttagtgtatttttttatgtttagtagtaagggtagtattgttgttgattaagtatttgttatgttggggtttttgtgtggttttggggttttttttttttgtttatatttggtagtttagtttttttttttgtattttatttgatgttggggttttgggtaagtttgggggatttgtgttttattttatagattttttagttgattttattagtttttgtatagggtttgtttgaagggttgttgggttgggtgttaattagagtttttagtagtagtttttttggttttttgattttggtttatgttttaggggtagggtttttaagggttttggggttgtttttgaggttagtttttttgttgattgtagtttatatagaggagggtttaattttgagtgtggttgtttgtgattttgagagatgtttagagttgtagatgtgttttttaagttttttagagtttgggataggagttatttaatgtttttagtgttataggtaaaatttgttttttttaatataaattgtttttagttttatttaatgttttttttaatgagtagtaataaaaatatggttttttgttaaaggtggggtttatagttttttagaatttggttttttgttaggtttaggtataatttataggagtgtttgtttttgatttgtgtgtgtgtgtgtgtgtgtgtgtgtgtgtgtgtgtgtgtgttgtgtgtatgtgtatatgtgtttgtgtaagtttttttatgtgtagttttgggaagggtggagaggtttatggaaattttttttggtatttagtaagttagaaaaaaggaaaatgagatttgtgtatatatgtgtaagtgtatatatagtatataggtatatatatatatatatttagtatatattatataggtttatatgtgtatatatgtgtaggtatatattatataggtttatatgtgtatatatatgggggtatatagtatataggtatatataggtatatatatttttttgtaggaaagtttttttttgttttttattttgtagggtttttaggttttatgaaataagattgaattttggaagtttgataaaaggtttgtttggagtattttggttatttttattagtttttttagttgtggaaggtatgttttgtggtatttatttattttttgtttttatttttatttttgtttttgtttttttttttttgtttttttagtttatatgttgtttgttttaattttaatttttgtatttggatgggaattattttttttgtagaagggtgtaatgtatgtggggatatatatatatatatatatatatatattgtattggaggagagaagagaggtagagttttttttagatttagagttttagtgagtgatgggattttttttagagaatatgtgtagaagtttgtgttattggaagaagatattattttgatttatattttttttttttttttttgttttttttatagagaaggaaaggttttagtaaatagtggttatgtgggttttttgtatgttattggtagttttttagttaggattattttttttttatttttggaagtataagaatagagagaagggtgagtttttgtttttgggggtttttttttgtatttttttggagttaattttagggttgtgggttgtataggaaggagggtttaataggttttttgtttaattttgtttttttagtgaggagttgatttattttgtttgtaaaagatgttggttgggatttgatgttgggtaatttgaggagaagagaagggggataggggttgaggttaggtttttggttttgaaatagttataatttttggggtagagtttaagggtgttaggttggagattttatatttggttagttggtagttattattttggtttagttagtggtttagggtattatagttatttagattaggaattttatttttttggattgtattaatgaggaaggttgagtttgtaggttttatatatttatggtaattttaaggtagagaggttattgttaattgagggttatgggtaggagttttgtgagtttattagtaagtttggaagattaaggtttttggttatagagagtagttgttatttggttaattttgtagaaaatattatagttttggataaaatatttgaaagaataaaataataatagtttggagttagtatagaatattttaagtaggtagaagttggagtagagtttatatttgatagaggggaataaaattagataagtttttggtttttggaggtttttttgtttagaggtaggtattgagtaattaaatttggataaaaagttttaaaagtatttagggaaaaataatatgtggtttataggggaatagttagatgaatgttgattttttgatagaaataatggaggttaaagatattggaattttatattttaaagttttgaaagaaaaaattgataatttagaattttataattagtgaaattatggtttaagaatgatagtaggttgggtatagtggtttatatttataattttagtattttaggaggttaaagtaggtagattatttgaggttaggagtttgagattagtttggttattatggtgaaattttatttttattaaaaatataaaaattagttgggtatgatggtatatgtttgtagttttagttatttgggaggttgaggtaggagaattgtttgagtttgggaggagaaggttggtgagttgagattgggtaggagttttgaaattatattattgtattgtagtttgtggggagatagagtgagattttgttttaaaaataaaaataaaaataaaaaaagaaagaatgatagtaaaataaagatttgtagataagtgaaaatgaaagggaattagttgtttgtaaatttgtattataaaaattgtgaagtaagttttttaagattatgggaaatgagattagatgggaatttagttttttaggaaggaatgaagagtataggatatagtaaatatatgggtaaatagaaaagattttgttttatttttaatttttttaaaatgtatggggttgtttaaagtaaaaatttttttattgtattgtttagtttataatgtgtatggatgtagtaaatatttaataattattatatataggatggaaagtggtaaatgaatttataggattgtttagtttttatattttttttttatgaagaaaaataatgttaattttaagtagattgtgaaaagttaagaatgtgtaatagaatttataaagtaattattaaaatagtaatataaagagatataattaaaaagttaaaataggttgggtttagtggtttatgtttgtaattttagtattttgggaggttagggtgggtggattgtttgaggttaggagtttgaggttagtttggttagtatggtgaaattttgtttttattaaaaatataaaaattagttggttgtggtggtaggtgtttgtaattttagtatattagggaagttgaggtaggagaattatttgaatttaggaggtagaggttgtagtgagttaagattatgttattgtattttagtttgggtaatagagtgagattttgttttaaaaaaaaaaaaaaaaaaaaaatataaattaaaatagaattttaaaaaatatttaattaatataaaagaagttaagaaagtaagatgaaagaaataaatattaaagagtaaggtagtagttttaaatttagttatatttataattatgttaaatagaaatagtttgaatattttaattaaaaggtggaggttgttagaatgaataaaatagtaagatttaattatatattatttataaaagatgttgttttagtataaatataggttgaaattttttgtttggaaaaagatatattgatgttgtttgaatgatgatggagttatgttttgataaatttattataagtggaaaataaatattattttaaaaatgtatttaatatatttaatttattgaatattttagtttagtttagtttattttaatatgattagaatatttattttagtttatagttgagtaaaattaataaatataaagtttattttataataaagtgttgattattttatgtaagttattgaatattgtattgaaagtgagaaatataatggttttatatatatttaaagtatagtttttattgtatatatattatgtttgtattatggtaaagttgaaaaattgtaagttaaattattataagtttttttataagtttttttagtttttttatgtattttaaatagtatgtttaagaaggttggagaggttatataaatattaataaagttgagtttaagataaaattattatgagataaaggaatatatttattatggttaaatgattagtttattgagatattattataattataaatgtgtatgtatttaattaaaggagttttaaaatatatgatataaaatttgaaagaattaaagggagaaatgggtaattttataattataggtggagattttttttttttttttttgagatggagttttatttttgttgtttaggttggagtataatggtgtaattttggtttattgtaatttttattttttgggtttaagtgatttttttgttttagttttttgagtagttgggattataggagtttgttattatgtttagttaatttttgtatttttagtagagataaggttttattatgttgtttaggttggttttaaatttttgattttaggtgatttatttgttttggttttttgaagtgttgggattataggtgtgagttattgtgtttggatgtatagttggagattttaatattattttagtttatttaggatgttaaaataaaatgttttaggttgggtaatttataaatagattgtagtgtttatagttttagaggttgggaagtttaaaattagggtgtttagtgtttggtgagagttagttttttgttttagagatgttttttttttgttgtgtttttatatggtagaagggattaattttatttatgatgattttgtttttatgagttaatatttttttgatgttttaatttttaatattattgtattagagattaagttttaatatatgaattttgggggatataaataggtaggttatagtaaatattatttttttaatatttgagaaataagtattagataatttgaagaatattggtaattagtaattgatttaattagtagttataaagttttatatttaggaagtttagaatatatatatatattttttttttaagtgaaaatagtgtatttattaagatatatattttgggttataagttttaaattttaaaagtatgtaaaatatgtttgtttggttaaagtaagattaaattagaaattaatagttttaagatatttagaggagttttgattatttgtaaattaaataatatatttttaaataatttatgagttaaagaggaaattataagaaaaattttataatattttaaatgaaatgataatgaaaatatagtatattaaaatatgtaggttgaagttagtgtttagagggaaattgtaagtgtttatattagaaaagaagtaaaaaaaaaaaaaaaaaaaaaaaaaaaaagatttaaggatttgttttaagaatttggaaaaatgggttaggtgtagtgtagtttatgtttgtaattttagtattttgggaggttaaggtaggtggattatttgagattaggagtttaagattagtttggttaatatggtgaaattttgtttttattaaaaatataaaaattagttgggtatggtgggtatttttagttatttagaaggttgaggtaggagaatggtttgaatttgggaggtggaggttgtagtgagtttagattatgttattgtattttagtttgggtaatagagtaggatgtttttttaaaataaaataaaataaaataaaataaaataaaataataaaaaaaataaagaatttggaaaaatatgttagttatttatgtattgttttttaattttgtatatattttgttaggttttgttttgtgatattggattgaggttttatgagtttttttttttggttaaatatagttatgttaggttttatttataggggataatattgtggggagttgttaggttttgttgaggtagtagtttttttttttggttttagggttttttttttttttgaaggtatagttgttagtggtgtgtgtttagtggggtttgttttgtattgagtttttttagtattttagttttagtttaatgggattttagtaaattttttagatatttagtttttgtttatttatattttttagtaggttttttggttatttagtaagttgattttgtagatttattttttttatattttttggtaagaatttttttgttattagtaggttgtaggtttttgtggtagttatatattttttaataaggtttgaatgtaagatgtggtaaggtgtggaggatgttttgagtttttggttttttttttattaattttagtggtagtaattgtttttgtgtgtttgtatatatgttttaaagtatttattatagaaaatttattattttaattatttttaggtgtgtagtttggtggtatgaagtatatttatattgttgtgtaattattattattatttattttatttttttaaattgtaattttatttttattaaatattaattttttatttattttttttttttttagtttttggtaatttttattttattttttgtttttttgaatttgattattttagggattttataaaagtgaaattatatagtatttgtttttttatgtttggtttttgttatttagtatgtttttaaggtttatttatgttatagtatgtgttagaattttttttttttttttttttttttttttttttgaggtagttttgttttgttgtttaagttggagtgtagtggtatggttttggtttattgtaatttttatttttttagtttaagtgatttttttgttttagtttttttagtagttgggattataggtatatgtttttatgtttggttaatttttgtatttttagtagagatagggttttgttatgttggttaggttagttttaaatttttgattttaagtgatttgtttattttggttttttaaagtgttgggattataggtgtgagttattatatttggttttttttttttttttaaggtagaataatattttattgtatagatggattatattttgtttgtttatttatttgttggtggatatttgggttgtttgtattttttggttatgggaaaagtgttgttataaataagaatgtagtatatttgtttaagtttttgttgttagttttttggagtatatatttagaagtggaattattggatgttatggttattttgagtttaattttttgagtaattgttatattttttttatagtagttgtattattttatatttttattagtagtgtatggggttttaatttttttatatttttgttaatatttgttgttatttatgttttggttaatagttattttaaagggtgtgaaattatattttattgtggttttgatttttatttttttgatgattagtgatattgtgtatttttttttgtgttttttggttattggtatgttttttgtggaaaaatgtttgtttattgggttgtttttttttgttttgtggtttagttgtaggagttttttatatattttggatattagttttttattggatatatgatttttaaatatttttttttattttgtggattttttttttatgttattggtagtattttttgatgtataaaagttttaagttttggtgaagtttaatttattatttattttttttgttgtatttttggtgttatatttaagaaagtattgttaattttaatgttatgaagttttttttttatgtttttttttaaagtagttgttttttatatttgttttttttatattttttagagtttttttgtataaggtaaaataaattttatttttttatttttatttataatatttagtgttttagttttgatattagatgtgtggtttttttttgttgatttttaagtaattttttaatatttagtagtttttaattgggtgttttgtaatttagtttaattttgatattaattagagttagtgtagattttataggttaagggttttattttataagattgtttttaattttagagattagttgtaagtggtaagatattaggttatttataatttttgtttgatttggttataaatttgaggtttttataattttttttttaggtttaataatttgtttgagtgatttatagaatttaggaaattagtttatttaaaattgttgatttattataaatgatattttaaaggatataaatgaatagttaattggaagagatgtataagaaaggtatgaaggaagtggtatggagtttttatgggagggtatattgtttttttagtatttgtaggtatttaataatttgaaattttataaattttatttttttgggtttttagggaggttttattatataagtatgatatgaaatttttggttattgatgattaatttaatttttatttttttttgttttgtaggaggtggatgggaaaggttgtaagttttagttttttaattataaggttgggttttttggtaattagtttttatttttaggttgtttaggagtttttagttattagttgtttttttagtaaataaaaagatatttattattttggagattttaagagttttaggagttatatgttaaataaagttgggggatagagattagatagatagatagatagatagatagatagatagatagatagatagatagatagatatattgatttttgagatagagtttttttttgttatttaggttggagtgtagtagtgtaattttggtttattataatgtttgtttttttgggtttaaattatttttttattttaattttttaagtagttggaattgtaggtatatattgttatgttaggataattttttgtatttttggtagatatgaggttttattatgttgtttaggttggttttaaatttttgagtttaagggatttgtttgttttagttttttaaagtgttgggattataaatatgagttattgtattgagtttagtttaaatatattttttttatattataatgttatttttttgtgatttttttaatagttaattattttttatagttaagaatattttatattataagttgttatttaaattgttggtgtggtttttgttttttgattgggttttgattaatgtgttgaagtaagtataaggaaggaagtaatgaagataatagagaaatttaaggaaatggatattagaaaaggggagtttaatgttggttttttaaaaagatttagattgataattttttagttaggttgttgatgagagggagatggtgaatataaagttataataaaaggaatgaagtgttttttttatggattttattgatattatagtgataaggaatataggtatattttattttattgtgttttatagatattgtattttttataaattgaaggtttgtggtagttttgtattaagtaagtttgttggtattatttttttaataatatgttaatattgtgtttttgtgtaggagtttgatgatttttgaaatagtttaaatttttttattattattatatttgttatggtgatttgtgatttttttttttttttttttttttttgtttttttttttttgagatagagttttgttttgtttggagtgtagtggtgtgattttggtttattgtaagttttgttttttgggtttatgttatttttttgttttagttttttgagtagttgggattataggtatttattattatgtttggttattttttttgtatttttagtagagatggggttttattgtgttagttaggatggttttaattttttgattttatgatttgtttgttttggttttttaaagtgttgggattataggtgtgagttattgtgtttggttttttttttttttttttgagatggagttttgttttgttgtttaggttggagtgtagtggagtgtagtggtgtgattttggtttattgtaatttttattttttaggtttaagtgatttttttgttttagtttttttagtagttgggattataggtatttgttattatgtttggttaattttggtatttttagtagagatgaggttttattatgttggttaggttggttttaaatttttgattttaggtgatttatttgttttggttttttaaagtgttgggattataggtatgggttattgtgtttagtgattagtgatttttaatgttattattgtagttgtttttggggtatgatgagttatatttagataagatagtgaatttatttaataaatgttgtatgttttgattgttttattgattggttgttttttgttttttttttttttgtttaggtatttttattttttgagatttaataatattgaaattaggttaattaataattttataatggtttttaagtgtttaagtgaaaggaagagttatttgttttttattttaaattaaaagttagaaatgattaagttgagtgaggaaggtgtgttgaaagttaagataggtaaaagtgagattttttatgttaaatagttagttaagttgtgaatgttaagaaaaagttattgaaagaaattaaaagtgtgattttagtgtatatatgaagaagaagaaagtaaaatagttttaatgttgatatgaagaaagtttgagtggtttggatagaagattaaattagttataatatttttttaaataaaagtttaatttagggtaaagttttaattttttttaatggtatgaaggttaagagaagtgaggaagttggagaaggaaagtttgaggttagtagaggttaggttatgaagtttaaggaaagaagttatttttataatgtaaaagtgtaaggtgaagtagtaggtgttgatggagaagtggtagtaagttatttagaagatttagtttagagtattgatgaaggtggttatattaagtaatagaattttagtatagatgttttattttttattggaagaagatgttatttaggatttttatagttagaggggagaagttaatgtttgtttttaaagttttaaaggataggttgatttttatgagaggttaatgtagttgttgattgtaagttaaagttaatatttattgattgttttaaaaattttagggtttttaagaattttgttaaatttattttgtttatgttttagaaatggaataataggttttatttgatagtatatttgtttatagtatggtttattgaatattaaaaatttattgaggtttggtgtggtaatttatgtttgtaattttagtatttttgaaggttggggtggggggattatttgaggttaggagtttgagattagtttggttaatatggtgaaattgtatttttattaaaaatataaaaattatttaggtatggtgttatatgtttgtaattttagttatttgggaggttgaggtaggagaattgtttgagtttaggaggtggaggttgtagtgagttgagattgtgttattgtattttagtttgggtaatagagggagattttgttttaatttgaaaaaaaataaaaaaataaaaaagggttaagtatggtggtttatagttgtaattttagtattttgggaggttaaggtaggtaaattatttgagtttaggagtttaagattagtttggttaatatggtggtgaaattttatttttattaaaaatataaaaattagttaggtatggtagtgtatatttgtagttttagttatttaggaggttgaggtaggagaattatttgaatttgggaggtggaggttgtggtgagttgagatagtgttgttgtattttagtttaggtaataaagtgagattttgttttaattaaaaaataataataaaaaaaaaataaatagggtttggtgtagtggtttatgtttgtagttttaatgttttgagaggttgaggtaggtggattatttgaggttaggagtttgagattagtttggttaatatggtgaaattttgtttttataaaaaatataaaaattagttaagtatggtggtgtgtgtttgtaattttaattatttaggaggttgaggtataagaattatttgaatttgggaggtagaggttataatgagttgagattatgttattgtattttattttgggtgatatagtgagattttattaaaaaaaaaaaaaaattattgagatttattgtttaggaaaaaagaatttttttaaaatattattgtttattgataatgtattttgtgatttaagagttttgatggagatgtatgtaaagatgaatgttgtttttatgtttgttaatgtaatatttattttgtagtttatggagaagggataaatttgatttttaagttttattatttaagaaatatattttataaagtagtatttgttatagttagtgatttttttaatggatttgggtaaagtaaattgaaaattttttggaaaggattttttattttagatgttattaagaatatttgtgatttataagaagaggttgaaatattaatattaataggagtttggaagaagttgattttaatttttatggatgagtggtttaagattttagtagaggaagttattgtagatgtggtggaaatagtagagaattagaattagaagtggagtttggagatgggattggattgttgtaattttatgattaaatttgaatagatgaggagttgttttttatggatgagtagataaagtggtttttggagatgggatttattttaggtgaagatgttgtgaatattgttgaaatgataataaaagatttagaatattatattaatttatttgattaatttgtggttagggttgaaagaattgattttaattttgaaggaagttttattgtgggtaagatgttattaaatataatgtgtgttatagaaaaattttttatgaaagaaagagttaatttatgttaaaaattttagttaagaaattgttggttaggtgtagtggtttatgtttgtaattttagtattttgggaggttaaggtaggtggattatttgaggttaggagtttgagattagtttggttaataaggtgaaattttgtttttattaaaaatataaaaattagttaggtgtggtggtaggtatttgtagttttagttatttgggaggttgaggtaggagaattgtttgaatttgggaggtagaggttgtagtgagttgaaattgtgttattgtattttagtttgggtaatagagtaagattttgttttaaaaaaaaagaaaaagaaaaaagaaataaagaaattgttgttatagttatttttaatttttagtaattattatttggttagtagttattaatattgaggtagattttttattaagaaaaagattatggtttgttgaaggtttagatgattattagtattttttagtaaaaagatataatgattttatatattttaatagattatagtatagtgtaaatataattttttttttttttttttgagatggagttttgttttgttatttagtttggagtatagtggtgtgattttagtttattgtaatttttattttttaggtttgagtaatttttttattttagttttttaagtagttgggattataggtatgtgttattatatttagttaatttttgtatttttaatagagatgaggttttattatgttggttaggttgtttttaaatttttaattttaaatgatttgtttattttggttttttaaagggttaggattataggtatgagttattatgtttggtttaaatataatttttatatgtattgggaaattaaaaagtttgtgtgatgtgttttattgtaatatttgttttattgttgaggtttggaagtaaattttaggtatgtttgtattatgaataattttaaatgagtaaatttaataatttatttgaaagggataaatttttttaaagtataatttattaaaagtaagataaggggaagtaaaaaaatttgaataattttttttatatattaaattgaatttgtgattaaaaataaataattattttttttagtagaaaattttaggtttagatggtttttttggtggattttattaaatatttaaggaagaaataatattaattttatgaaaatatagaaaataaagagaagggaatatttttaaattaattttatgaagttaaaatgaggttgataaagatattattgaaataaattaataaataaagaaaatattatattaatattttttatgaattaatatgtaaaaatttttaaaaattgggtaaattaaatttagtaatatataaaaaggatgatattttataagtaagttggattttttttagaaatgtaaggttggtttaatattaaaaaattaggtttgtatagtggtttatatttgtaattttagtattttgggaggtagaggtgggagtattgtttaagtttaagaattgtagattagtttgagtaatataatgagattttatttgtataaaaaattttaaaaattaaaaattagtttggtatggtggtatgtgtttatagtttttgttatttaggaggttgaggtgggaggattgtttaagtttaggagtttaggttgtagtgagttatgatggtattattgtgttatagtttgggtaagagtgagattttgtttttttaaaaaaaaaaaaaaaaaaaatggggggtaaaaattaattattgtaatttattttattaaatgaataaaagataaaataatgattatttttatagatgtagaaaaagtatttattaaaattatatttatttatgttaaaaaattttagtaaattaagaatagaagggaatttttttaatttgataaaggttatatatgataaatttaaagttaatattataagtttggtataggtaaggatgtttattaattattattatttaatattgaattggtagttttaattagtgtaataaagtaagaaaaaaaaataaggtattaagattagaaagaagtaaaattatgtatttaaattttaaaagatttataaaattattattagagtaataaatgattttggaaaagattataggatataagatttatatataaaaatttattgtatttttatatattagtagtaaataattaaaaatgaaatttaaaatttattttagtttaaaatagtgttaaaagtaaaatttttaggaataaatttaataaatggtatgtaagattttttttttgaaaattataaaataatgtaattttgtagagatttttttttagtagagaaataaaagaaatataaaaggatttttaaaatggagatatattatttatataaaagatttaatattgttaaaatgttaatttttttttaattgatttatagatttaatataattttaattaaaatttatattgtatttttgtagatattaataagttattttttaaatttataaggaaatttaaaggatttagaatatttaaagtaatattttagatatttgagagattttatattaagatttattgtaaagttatattaattaagatgtggtattagtaaaggaatggataaaatattaagaaaatataatagtgttttaatatagggtttatatgtatatagtatatatattaatataggattatatatatagttaatataggatttatatgtatatagtatatatattaatataggattatatatatagttaatataggatttatatgtatatatgtatatatattaatataggattatatatatagttaatatggggtttatatgtatatatgtatatatattaatataggattatatatatatatatagttaatatagggtttatatgtatatatgtatatatattaatataggattatatatatagttaatatagggtttatatgtatatatgtatatatattaatataggattatatatatagttaatatagggtttatatgtatatatgtatatatattaatataggattatatatatagttaatatagggtttatatgtatatatgtatatatattaatataggattatatatatagttaatatggggtttatatgtatatatgtatatatattaatataggattatatatatagttaatatagggtttatatgtatatatgtatatatattaatataggattatatatatagttaatatagggtttatatgtatatatgtatatatattaatataagattatatatatagttaatatggggtttatatgtatatatgtatatatattaatataggattatatatatagttaatatggggtttatatgtatatatgtatatatattaatataggattatatatatagttaatatggggtttatatgtatatatgtatatatattaatataggattatatatatagttaatatggggtttatatgtatatatgtatatatattaatataggattatatatatagttaatatagggtttatatgtataaatgtatatatattaatataggattatatatatagttaatatagggtttatatgtatatatgtatatatattaatataggattatatatatagttaatatagggttgatatgtatatattaatataggattatatatatagttaatatagggttaatatgtatatatgtatatatattaatataggattatatatatagttaatatagggtttatatgtatatatgtatatatattaatatagggttatatatatagttaatgatttttagtaaaggtgttaggtaatttaatagagtaaggtatgtttttttaataaatggtgttagaattggatatgagtatagaaaaataagaattaattttgattttaaattaaatataaaaattgatttaaaatggattatataatattttgatggttataataggttaaaaaatgtaaaaatttaaaaaattaaaaaataaaaggaattatagaatatataattataaaatttttagaaaataagagaattttttttgattttagtgtaggtaaagattttttttataggttataaaaattataaattgaaattggaaaaagttgataaattggattttatgaaaataaaatatttttgtttattaaataatattattaagaaaattaaaaggaaaggagtaatgtggaaaaaaaaatttatgatatatatatttgataaaggatttatatttagaatatataaaaaatatatgaaataatatttttttttttttttttttttgagatagagttttgttttgttatttaggttggagtgtagtggtgtaattttggtttattgtaagttttgttttttaggtttatattatttttttgttttggttttttgattatttgggattataggtgtttgttattatgtttggttaattttttgtatttttagtagagatggggttttattgtgttagttaggatggttttgattttttgattttgtgatttgtttgttttggttttttaaagtgttgggattataggtgtgagttattgtgtttggttaattttttttttaaatgagatttatggggaaatagttaaatgaagaaataataaagtagtaataaaataaaatttaagttttattttattgtgtagttgtaggataaagagtagaagtttgtagttggggaataaggtgtttatttttttaagtattataaaatgaaggttttagaaattatttgattttgaaataatataattttaaaaagaagtaagatgtggatagataattttataaaggaaaatatgtaaatgattaataaggattttggaaaattgtgtgattttataagttattaagaaaatataaaataaaagttttaaaaaaaaatgaagtttggaataattgaataaatatataaaatgataataaaatgaattttgattttttattttatattatatgtaaaagttaatttataaaagttatataattttaagttttttaaaggaaaatataaatatttttgtaatttggtagggtaggtaaaggttttttataaagaatatagagagagaattataaagaaaggagtttgttaaattagattttataaaaattaaagtgatatatttttgtttattggaaaatattattaagaaaatgaataggttgggtatggtggtttatgtttgtaaaattggtttttggggaggtagaggtaggaggatagtttgagtttaggagttttagatttgtttgggtaatatagtgagattttgtttttgaaaaaggaaagaaaatgaataggtaagttatagattggaataaaatatttgtaaaatatgtatttgataaaagattagtatttagaagaaaaagttaagtaatttaattttaaaatgagtaatagatttgaaaagatattttataaaggaaaaatatatgaagagttaattatgaaaatgtgtttaattgtattagttattaggttaaagtaaattaaagttataatgagatgatattattatatgtttattagaatgattaagattttatagagtgatagtattaaatgttggttaggatgtggagtaattagaatttgtatttattgttggtgggagtgtgaaatggaagggttattttgggaaaagatttggtagttttttataaaattaaatgtatatttattttatatttattttaggtgtttttatagaataaatgaatgtttatatgtatagaaaaatttgtataagaagaattagtgtaataggtttatttataagagtttttagatggaaatagttaggggttttttaataagagaatgattaaaaatttatagaatgtttatatagtggatgttatttagtaataaaatagaataaattgttggtatttgtagtaatatgggtagttttaagaaatatttaaattggtaaaattattttgtggtggaaaaaaagtataattgtggttgttttggggaaggtggggattgtgatgtatttggaggggtatgaggaatttattggggtgatagtgatgttttatgttttggttaggttgggatatatgtggatatttttgttaaaatttaaagaatggaatgttttatatttgtgtattttagggtatatatattttattttaaagaaaaataaaaataattatagataaatgttggattttagttaatgaaatgtaaattgaggtgttgataggatgttgtgtgttgatttttgtagtttattttaagtgtattaaaattagtgtggatgttggtggttagagggatttgtggtgaagtaaatagtaaaatggttgttgtggaatttaggtggtaggtgtatgggtgtttattttagaattttttatggttttttttttgtggttttgttttgttttgtttttgagatagggttttgttttgttgtttaggttggagtgtattggtataattttagtttattgtagttttaattttttaggtttaagtaatttttttattttaattttttgagtagttgggattttaagtttgtattattatgtttgattaattttttgtattttttatagagatgggattttattatattgtttgggttggttttgaatttttgggtttaagtgatttttttattttaattttttaaagtgttgggattatagttatgagttattatatttagtttttttttattttttttatgtttgaaaagttttatggtaaaaagttggaaaaatgtaaaaaagattgaaatttattaattaaaaataggaaaaataaaataaaagagatggtaggagattattttttttttttttaatttagtttttaattttttttttttttgtttagttaggataggaattttaagggtttgggttttttgtgtttgtgtggggaaggaggtatttttgtgtttgtgtgggggttggttatttgttttttggtgtattttttgtattttatttttttttgtttgtagtgagtagttatagttggtggaaattatatttaggtagtttttgtttataaatttagtgaaaatgtaaattttgtaggagttggatttttgagagtttgtggtgttatttgttggaggaaaggttttttgtatttgagtttttttttttttttttgttgttatttgtttttttgtttaggttgggtgggttttttttttgtaattttggggtattggtgtatgggaaatgtttagtgttttataatttttttttatttatattttaatatttagtttttagtggatattgtttttgtttgataaatatattatataggtatagtttaagattatttattttaggaggagtataagttttagtgtttattattttagtttttttttttttttttttgatgtagtgatataggtttaggatattgaagatttttgattttataaatatgttgaagttaattattttgaagttgtagtttttattattattattattttttattttttgtaaagataaagttttgttatgttgtttagtttggtttggaatttttggatttaattgatttttttgttttggttttttaaagttttgggattgtaggtgtgagttattgtatttagtttgaagttgtagttttttaattattgttaatagtaatatttatttttttgtgagtagtagggtttgttggtatggttgatagttttgtattattgtattgaatttgttgtttgggattttaggtgagttttgatttttagttggagggataagttgtgtggggttgggtagggtgaattgtgggagattaagtttagattgagggttataagttatatgagtattggggttaggtagggatagtgaaggagatagtgtaattttgaggaaagataatgttatagaatggagaggtttaggtttggggtttttttttgttgttggataggtatgtttgtgttttttttttagtttttgtgatggttaagttatgtgttttttgagaggtaagtgaggtttttgatagtaggttttaggttttaattaaattgtttgttttgtagggtgagttgtataggtgtttttatttttgatttttttgaatttttgttgtttttaagttttatttattttttttaggtgaatagaaatattgtttaggggagaatggaggaagaatttaggaaaggttgtttgagagtttggttgagtttatgttattgttaagagtagtgttaaaatttaggagttggtgagattatggtttagggtttatattaatatgagggggtgttagttttatgattaatgagtttttgttttattattttttgttatttatattttgagggttatagttagtatgtgaattggagttggtttttggtatttttttttttatattagttttataatgtgaggtgggggtttgtttttagaggtatttggagtagtaggtgttttaagagggggaagtttttttgaagtttttttttatttatggtataggatgtagaggggatagagtattaggaatatttagtgattataggggtttgttttgaaggagaggaggtaggaggtagggagagtggttgggaggttagttttggagtgtttattttttattttgagggagaggaaggaagtagaaggtgagtatagggagttttagttggggatggagtgggggttgtagtttgattgtgttgtttggagtgggggtatggattgtagtttttatttatttgtttggttagtttgaagttattttaagtttggagattttatttgttttgtttattttttttagggatggtgtttaaattttgaagttttggttggtgttgtaaatatgggagggaggttttgttttattttagttttaagagttagttaagaatgttttggatatttgaattttgttttgagttagaggttgggaagaaatttgaaggatggtgggatggtggatagtagtttttaggtattaggtattagggtttttgtttggggatgggggtattagtaggtgttaagtgtattatattagggtttattatgtttttgtttagagatttagtattttatgaaataggaaggaatgagggatgagtgtgtttttttttttaatattttagtttttgttttgaggttgttaggtatttaatttttttaggatttaaattattttggttttatttatggttaagtgtattaaattatagttaggattattgggtttagatattaaaagtgttttttttaaagttggtagttattagggtagtatagggtagtgtaaggttgggtagggttggttatttgttagtatttagtggtttttgttggatgttgatgggggtagttaggtaggtgggtttatttagtaattaaagagattttttttttttaattttttttttaaagagattttgattttttttttttagttgtagggtttgtagtagttttttttttagtaggtttttttgtttgtttttggttatttttagtagttatagggtattgaggttttattatagtgagaataaaattaagtttttattagggtttttaaggtttggtatgatttggttttgtttgttgtattggtgttattatggtttgtttttgaaaatatattttagttatttttattttttttaggttttagttttgggtttttatatttgttgttttttttgttaggttgttttttttttggattttggtttggttgggtttttttggttattatagttttagtttagtgttattatttagaaagggtttttattaatttttttgttatatatatagatatgtatttttagtaatttgtttttagtttttttatagtttttatttaaaattatttatggatttgtttatttgtggattgttttttagttttaattgttaagtaataagtgattagtgattgtgtttttgttgttttttattataggttaagtatttaagagaggggttgtatatagtaggttttaataaatatttattagatgggttaggtatggtggtttatgtttgtaattttagtattttgggaggttaagttgggtggattatttgaggttaggagattgggattagtttgattaatatggtgaaattttatttttattaaaaatataaaaattaattaggtatggtggtggatgtttgttattttagttatttgggaggttgaggtaggagaattgtttgaatttgggaggtggaggttgtagtgaggtgagatggtgttattgtattttagtttgggtgatggagtgagattttgtattaaataataataataaaatatttgttagaagaattaaagtagtttgtttgtgtttaataggaatttaagagtataagatgaatttaattaaaggatatatatagtaggtattttatagttgatatttgttggtggagggagattaggaaagtggggagaggtagtgtttgggtatggggatattttgggtatggggatgttttggatatagggatatattgggtatggggatattttgggtataggatgttttgggaatggggatattttgggtatggggatattttgggtatggggatgttttggatatagggatattttgggtatggggaaattttgggtatggggatgttttggatatagggatatattaggtatggggatattttgggtatggggatgttttggatatagggatatattgggtatggggaaattttgagtattgggatgttttaggtatggggatgttttttgttatttgaaattttgtagttttattatatttgtttgttttagtaaattggtttaaagagtatttttaagtttttatggtaaagttttagagttagtgtttttttgttgattttgagggtgtgttgtttatttagtgtttaagttagagtttttttatttagaaaaaaaaagaggagggtggttttatggatggaggtatgagggtgtttataggtagagggagtttttgggttgagatttgtgttattttttgttttaattttaaggtgtagtttggagtttaaattagtttttaaatgtgggttgttggttaagaggaatttttttatttatgatttttttttatatttagtttttattgtttagagtatgttagttttgtttgttttggtttttaggatttttttagggatttttaggttttaagttagggtgggtttgaattaaggtagttttagaatttatgttaatgtttttgttagtgggagattttggggagtattgtgtgggatgtatggggttaggtgggggtatatagtgagtggttttagaagttttggttgtttggagtgggggggtgtttagagtaagagatgggttaggaagttggagtgagtaaggaggttttagtttttggtgggagtaggttgggtaaaaataaattaatttgagggtagtagttagtgagattattataggaggggtggtggggttggaggggttttaggagtttaggagagggaggtattgttagaggtaaggttggtagatgagagttagtgttggtaggattaatttgttatagtagttatggtttattttttttttttttttttatatatgtttttggggtttatggaatttattagtttattataaaggatattataaaggatataggggaagagatgtgtagggtaaggtatgggggagggatgtagagtttttatgtgttttttaggtgttttattttttaggagtttttatatgtttatttatttagaagtttttggaattttatttttttgagtgtttatggaggttttattatgaaggtatgattgatttaattattggttgttgatgatttgtttaatttttagttttttttttttatttggaggttgtggggtggtgttgaattttgtgattttatttggttttttttgggaattattttgaagttgttagttggtttgttaattatgagtatttaaaaagatattattttggagattttaaggattttaggagttgtgtgttaggaaatggagatgaaaattaagtgtatattttataatatgatagttagttttttttaattttagttttattttttgttgtgttgttggttttagttttttgtgttttagggtttttgaatatattgttggttgtttgtagtgattgtttttgtttgttgggtttgagtttggtttattttttttatttttttgtgtttagtttgaaggtgtttttttgaggtagtttttttgatttggttttatgaattgtaggttttgttttgttattggttttttttgttatatttgttattttttgtgttttatgtttattgatgtggttttgtatttgtgtagttttatgagggtaaggattgtgtttggttttgttttttatgggattttagtgttaagtttatagggagtatttaatgttgaatgaatgaatgagtgattggtaagggaggtttattttgttatgttgggggttaaaggttgttgggtggattatatgggtgaggttgggtggggagggaagtagagatgattttttggaagaaggggtaggaggtggggaggtgggtgtggggtgttgtataaggatggtaagtgtttttaggggtgataagttaatttagagtattaggtagtagaaaaaggttgatatttttatgttttatttttatttagggagaggttaggtttttgggaaagttagttttttgttgttaggagagttttaagggaagttttattagttgttgagttggttatagtggaaatttatgtggtgggtgggaggggtttgaggtataggggtttgggtggtggttttaggatggagatttgtgtttagattatgaggggtggttttagggatgattatttttaaataggaagtagataaaggtatagatggtagaagtggaggtagagaatgggttgtaggggtttttttagagggagagttgagtaaggggataggttggaaatatttagtttttatggtttgaagtatagatagttggttttatatgtaggttgggtagttatattatttagaataaggggtatgtttgtagggtaggttttaggatgttttgggttggttttgttattagtttagaaagatggtttaggtttttttggtagggagtatgtttagttaggttttgggtaggagttgagattttttggttggtttgagaggggatgattgagtgtaggtttagtttgggatttttttatttttttttgttatttagtggaattagttgggtgtgagaaaagaagagaagtgaattaagagtttagagtatgaggttggattagtttttatattatatgtaaaaattaatttaatttgtattaaagatttaaatttaagagttaaaattataaaatttttagaagaaaatataggggaaaagttttttgatgttgtatttggtaatgattttttggatatggtgttaaaagtataggtaatagaagaataaatagataaagtggaatgttatagaagtttaaaatatttgtatattagtttgggtgtggtgatttatgtttgtaattttggtattttgggaggttgagatgggtggattatttgaggttaggagtttgagattaatttagttaatatagtgaaattttgtttttattaaaaatataaaaattagttgggtgtggtggtgggtgtttgtaattttaattatttaggaggttgaggtaggaaaattgttggaattagggaggtggaggttgtagtgagttaagattatgttattgtattttagtttgggtaatagagttagattttattttaaaaaaaaaaaaaaaaattgtatattaaagggtattaataatgtggggagaaggtaatttatggaatggtagtaaattataggttagatatgggattagtatttggatattaatttatagattttttaatatttagtaataataattatttaaattaaatataggtaaaggatttggatagatatttttgtaagaatatgtgtaaatgagtaataaatatgaaaagatgtttaatattattaattattggggaattgtaaattaaaattataaggagagattttttataattatgagttttgggtaggtaggaagatgtttggtggggagttgttggttttatgttgtttttagaatttttgtaggggttaagtttgattttgatattttattaggagtatagaaatgagtggaaaaggttaaaggttattttaaagggttagaggggtttagtaaggagtttgggatatggaattatgttgtgtatttagatatatggggataatagggggatgaaaggtggtttttaaaatttatatttattttagagtttatgaatatggtttatttggaaaaagggtttttgtagatgttatgaagttaaggattttgagatgggattattttgggttatttagtgggttttaaatttgagaaagattgtttgtatgagagatagatagggggagatttagggtatagaaggaggttttgtgataatggaggtagaggttgagtggtgtggttatgagttaaggaatgttaagggttttgggagttgttagaagttgttagaggtgagaagtaggtttttttttggagtttttggaaagaattaggtttgttgatgttgtgattttggatttttggtttttagaatggtgagagaagaaatgtttggtgttttgagttatttagtttgtggtatttggtgatggtagttttaggaaattattatagggattagagtttttatggggttgggtaggaagtgggtgtagagtgtgttaggttaggttttttattttggagatggaaaagtagagttggagaggttgagattggataggtattgagtgtttaggggtaagaatttttaggggatggtagaggttattggggatagtatagtgagggataggagggaggggtgagggttgaggtattgttttttaggaggttttggttttttgtttattgatgatttaggaattttgtaagaggagttgggttttattttgtgttgtattgtattagatggattttggtggggatagatgtttagtgatagtgtggttaagttttttttaggattttgggtttgtatttatgattatgtatagatggttattttttttgtttgtagtttttttttgtggtttgtttttagttttttagtttaatagagttttttagtggaaagttttttttttggagattttttttttgttgaaatataagtttttggaataagataaaattgtttaatttgtaaaagttataaagttgttttagaataaaaaaaaagttttgatttttggttggaaggagtggttttttatgttttagtggttagttattattttatgatttatgttggttttgttgataaattttttagtatttttttaggggaaggttatagtttttagggagggtgggagagtatttaggtttttgtttataaattagattggagttagatattgttgagggagggataagagggtaggttttggggtttttaagttttttttggggttggtagattattgtggatttattagggtaggattatttttttttataaattttttttgggtagttgtagggtagtttgagttggatatgttttatatgttagtttagtggggtatgaggtatttatagttatgtttggaagttagtgggttggtatttgttgggtaggtttttgttatataggtatagtgttttttttatggtttttttttaggttagagtatgtttggggattagagtagtttttgtagtggtttgtagtttgataatgtggtgtgagttatgttttgtagagaagaagagttttttagtgagggaagaggtgtttataaaatttaggatatgtgtagaaatttgtaggaggtgggggtgttgtttaggggttgtgttgtttttattttttattttgtagatgatggaattgtggtttagagttgttaagtggtttgtttaaggttatttagtagggataggaaggaagttatttttttagggattgtgtgggagtttagtgataattaaagattagtgttaaagtttgtttaggatgagaattttattaagggaaatagttttgggattgttgtgtttatttggaaggtagttagtttataattgagtttttaaaaatgtatgtttttttatatgaaaatatatttgaatgggattttgtagaaagtattttttattaaggtatagtttgaggggaggtttttgttttatttttggttgtgttgtttttagttaagggtagtagggattagagtggtttttggggtatagtattggttgtttttaaagagtgttttgtttagtttatgaaaagtttgtgttttgtgagtttgggagggtgttattatttttagttttttagggagtattatttttaaatttatgtttttttgtttagtttttagattttttgttggttatttatttgggttttggttagattatttataaagtgaaggttgaatttgaggttttttgaggtttttgttagttaggtgggtggagtgatgtttttttggggttggtggtttaggaggtaggggatttattgtggtttgtttaggttgtttggtggggtggttattttgaggatggttttattgtgtaagtttgatgaaggttttttttagtgttttttgttttgtggtttttgttgggtggagagtaggatgttgggttttatatttatttgttttagtgggtttgagtttttgagtttaaatagataagatgtagttttattgttatttaagttttttgttgttttttttggtttttttttgaggtttgtttgttgtgtttgattgggtgtgtttagtggtataatatatatttgttttattagttttaatgtgataattaagatgtggttttgaggttgggtgttgtggtttatgtttgtaattttagtattttgggaggttgaggtgggtggattatgagattaggagattgagattattttggttgatatggtgaaattttatttttattaaaaatataaaaaaatatggtgggtgtttatagttttagttgtttgggaggttgaggtaggagaatggtatgaattagggaggtggagtttgtagtgagttgagattgtgttattgtattttagtttgggtaatagagttagattttgttttaaagaaaaaaaaaaaaaaagatgtggttttgggagtagtggtggaggggattatatgttttagagaggagttattgagatgggttttttttttttaggttttttagggattttttaatatatatatagtggtaattaatagattagggtttaaggtatgtaggggttgatatttttagtgattttttgttttatggtttgtaggttattttagaatatttaaagtttggagtttggtttagttattttatgttttttagtgttgggtttagagggtggtatgagtggtagaaattgttattattgttaattattgatgatggtgttggttatgtgagatggtagttatggtattgtatgtgagtgaagggattaaggaggttgggtttgggagggagggtttggaaagttggggtgaattaaaggtaggggagttttttttttttttatttgtttgtttatgttttgatgggtttgtgtttgtggtaagggggttgttagtgtgaatggatatatgtatatatatgtatatatatgtgtatatatatgttaggtttttttgagtgttgggagtttttttttttataattaattgttaggaaggtatagaaatgttattttaggtaggagattgaggtagttttgaagatagattttggttggaagtaaaaaataaattatatagtggataaattaattattagttaggtttaagtgttgttgttttagatttgagttaggggggtaggttttttatatttttttaaggttttggtgttaatagttttagtattgatagtggttatgatatgtaagaatggtatattggaaaatgaaagggaagtagttaggagagaggagagttgagtttaaataaaagttagatttaggagagtttagtttttgagatggagtttattttatgagtttggaattgttaaaaagaaaagaaatatttttgtgaaaaatgagtaaaagtgttttttgtatgtttatttttttaggtataaataaagttttgagtttagggtagtggggggtggttgatggggagggggttgtttgtgtatttgagatttggtttttttttatttttatggatatatttagtagtggtgggagttttggtgttttgtttagaggtggtttttttttttttatttttgttgtttttttttttttagttttttttttttttttttttttttttaaaaatattttttgtttggtttaatttttttaatttgttgtaattatgaatgtatttgaattattatatttttatgtgttgattatatgtttgtgttttaaattgaagtagtattgtttttttaaaatgggaggaaaaagggagtaaaggagagaaatttaaaaataggaggtaggagagagggtttgaagtgggttttgaggagtttggtagattattgggtttgtttgtgagagttttagagttttggttgtttggtttggttggtggttgtagaggttttgagtgtggtttttggtagttttttttttttattttttttagtttttgttgttttgaggtttgttgtttttttttaatatttatttggagatgtttaatttagatttttggaaattaatttatagagttaaatttttgatgatttttaaagttttttattttttttgttttgtgatgttatgatttttttgggtttaagggtttaaaaagtttagtttttgtgtgtttgttttgtttttttttgttttgggttggttttagtttttttttattttgtattttaatgtggttgggtaggaggaatggttgtgttttaggttagtgtgttgagaaaaggttttggagtatttgtttaggaggaattttgagaagttatttttttttgttttattagtttgtagtgatagaggtagttgttgtttttgtttaggtagagagggtgaatgggatggggattttttggaagatttttattatatatgtatgagttagtgagtttttagttgttttttgggagggagtgagtttttttttttgggaatttggggttttattgggggattagtgttgttttttattgtttatttggggtttttagaggttgtttatttatttggggggtttttattagtatatggttagggtttatgttgaggttaagggtttagtagagtaggtgggggtttataatgtgggtttttggggtgggaattaggggtattttttttgtttttaagttttattttaagggtttatttaaatttgagatatggaggttggttttgttggtttaagtttgtttaaagagaatgtgtgtttgtgttaaggttgagaatttaggtaatttttttgaaaattttagattgttagtttttgttgagaaagggaggatgtgtggttgtattatggaagtttttttgtttggttgtatagggttggtataagatagttttgttttttagataaaatattttttagtttgtgttgttttttaaggtttttaataaatttataatatttgtatttttttattttgatatattttgtaggtttttgagtttataatttttgttttatagagttaggtgagttatttgtgattaggtgaggtttatgtatagtttttggttagatgatagagttaaaggttttgaagtgttattttaggttatagttttgtttgttttttgtttgggataggattttaaatgtaatttttttggtagaaaggatatttttttggggggtggggaggattatttttagttttttgggagatattaagtaattatttttttttaaagagtttggaggatagttttataggtagttagatagtgagggaggtggggatagtattttagttgaggtgggaggttggggaggaagggagggattatagttatgagagaaggttgaataatggttttagggatagtatgttttaatttttagatttgtaaatgggattttgtttggaataagagtttttgtatttgtgatttagttgtagattttgttgtggtgagagtattttggatggtttaggtggtttttaaaggtagttttggtgtttatataagatgggggtagagggagatttgatatagatagggatggttaagtggagatggggtttggagagatttgtagatgttggtgttgaaggtaagggttatgtagttataagttaagggatatttatagttattagaggtttaaaggggtaggtgatgaaggtagtggtttttaatttttttggtatttgggattggttttagggaagataatttttttatagattagggagtggggagatggttttgagatgatttaagtgtattatatttattattttattttattttattttattgagatagagttttgttttgttatttaggttggagtatagtggtattattttagtttattgtaatttttgttatttgggtttaagtaatttttttgttttagttttttaagaagttgggattatagatgtttgttattgtgtttggttaatttttgtatttttagtagaaatggggttttattatattggttaggttgattttgaatttttgattttgtgatttgttagttttggttttttaaagtgttgggattataggtataagttattgtgtttggtttttattttttattttttgagatagagttttattttgggattataggtgtgagttattgtatttggttataagtatgttgtattgattgtgtattttatttttattattattataatatataatgagataattatataatttattataatgtagaattagttggagttttgagtttatttttttgtaattagatggttttatttggtggtgatgggagatggtgatagattattaggtattagatttttataagaagtatgtaatttagattttttatatgtgttgtttataatatggtttatttttttataagaatttaatgttatggttgattagataggaggtagagtttgggtagtaatgtgagtaatggggagtgattgtaaatatagatgaagttttgtttgtttgttagttatttattttttgttgtgtaggttagtttttaataggatatatggggttgggaatttttgttttagagtttttagagggttatgtttagtggatattttgattttagtttggtgattttgattttggatgtgtggtttgtagagttgtgagaggatggttgggtgttgttgtgatttagttagtttgtggttatttgttatagtagttgtaggaaattgatgtagtgttatagatggagttagggtttagtttattggagttgttttttgttattttatttttttttaaaatattgtgttaagttaattattaataattattgattttgatgggtaggaattgtagaggttttttggtttgtttttttaattttttttttaattttgaaataatattttttgttggtttttttgattataaatgtaatatttttttttgtattgagtttagaaataagagaaaaagtaaaaagtagaaattttagttgggtaaggtggtatgtgtttgtaattttagtattttgggaggttgtggtggaaggattgtttgaagttaggagtttgaggttgttgtgagttataattgtattattgtattttggttgggtaaaaagagtgagattttgttttaaattaaaaaaaaaaaaaaagaagaggaagaaaatttattaattttatttgagattttttatatgaatttttgttgtggggtagggaagtttaggaaggttttatgaggttttgatttagtttggttggtggtgggaatttgggaatagttttgagtgaggggttgggttatgattgagtttatttatttagttattttttgtatgttgtgtatattatgggtttgatggttagggttggagtatttgttgagtatagttttgatttttagttttatttagtatggtttggtttgaggtttattttttttttgtgtttgaaaatttaaatattttggtttaggtgggggattatttgaaatggaaaatttggtagtattgattggttttgaagaggtaggagttagttatgagttggttgggaggtgagtgtagaggtggtgaggtaaggttagtagagggtgggggaggtgagggttaattttttattgtgtatggtgtaagtattaagggggtattttattaggttagtgtagatttaggtttttgtggtggattttttgtggtttttttttttagaggaatattgaagaggtttttgtggttttgttttagatttagaggtatatttgtatattaaatgtattgagtaattttatagtgagggagttgggtttggtttaatttatttttttttaaattggattaaaggttgttgttttaggaaggtagggtttttaggtttatggttttgggaaattttggttgtgttagtttatgagtttagtttttagttattttagtttgtttatattttggagtgggtattgttatttaaaagttttttttagatagtttttagggtggtatttttgttttttattttttatagatttttggttatttttttgtgatattagtattattggtttatagttttttttaattgtaaagtggggtttagtggtataggttgggtttggtagggtgggaaggaagagtgaaggttattttgtttttaatagtattggttgggttttggaaaggttggaatttatagataggaaggaagtgttatatttatttaatttgttttgtgttagttagggggtattttgtagaaagaagttaggtggttgtggttgggtgtagtggtttatgtttgtaattttagtattttgggaggttgaggtaggtggattataaggttaggggttttagattagtttgattaatatggtgaaattttgtttttattaaaaatataaaaattagttgggtatggtggtgtatgtttgtaattttagttatttagaaggttgaggtaggagaattgtttgaatttgggaggtggaggttgtagtgagtttagattatgttattgtattttagtttgggtgatagtgtgagattttattttaaaaaaaaaaaaaagaagttaggtggttattttttagtttttggtttggtttaggaattgttttttttttaagatgttattaaatgttttttttattaggaagttttttttggttgttttttttatttttgtttttgttttagaatatggtttggtttttatggataattttgatattagagtttaatagagatttttttttttatggaaatttatattttaaattgaatatgtgtgtaggataagtttttgtttttatgtgaaataaaagtgaaaggtgtggattatttgtttttttttatttttttttataataatttgggttttataggggtttagtaggagttaggtttagtttagttgttttaggtgtattattttgggtattagtgtttttgtttttttttatgaagtatagttttattttttggtatttagtggggaggggatatatattaggtattttttagggtggattgtgttttttatattaggttaggaggttttggggttggtttagttatttagaaaagggagtaggtggtttaggtgatattgatgtgggtagtaggggtttttgggaaagggtttttgtaggattggttttattttgttttaggagtatatattggggaagggtgttgtgtggaggtggagagaatgtatttttggttgaaagtatgttttttgatgttttgggtttggatttgttgttattttttatgtttttttatttaatatatgttttagtaaattttttatgttgatgagtgttaagttatagaggatgtataattttttgttttaaaaagtgattttttttgttgggtgtggtggtttatatttgtaattttaatattttgggaggttaaagtgggaggattatttgaggttaagagtttaagattagtttgggtaatatagagaaattttatttttataaaaaaaaaaaaaaaaaaaaaaagtttaggtatagtggtttatgtttgtaattttagttatttgggaggttgaggtaggagaattatttgaatttgggaggtagagattgtagtgagttaagattatgttattgtattttagtttgggtaatagagtaagattttattttaaaaaaaaaaaaaatttttttttttgaaatagggttttattttttttgtttaggttggaggatagtgatgtgattataatttattgtagttttagttttttgggtagttggaattatagggttgtattattatgtttagttaattttttgtatttttagttaagatggggttttgttatgttgtttaggttggtttggagtatttgagtttaagtgatttttttattttggttttaaaagtattgggattataggtatgggttattatgtttagtttgaaaatattttttttaagaattagttagttatggtggtgtataattgtagttttagttatttaggaggttaaggtaggaggattttttgagtttggtaggttgaggttgtagtgagttataattgtgttattgtattttagtttgggggatagagaaagattttgtttagaaagaaaaaagaaaaaaaaaagatttttttatttattttttgtttatttttagatttaattattgaagtttgtttttttgaattaaaaatgaaggagttttgttttggatttttttttgttgattttgttattgtatttgttagtagagttagttaagattttttaggttggttttagtttggtttgtttatagttttttaagtaagatggatttttaggttgaggttagttgtatttttttttggaatttttttttattttttattgtgttttagattttggttgtttttaaataaatataatttagttatttttgtttttggggttgttgtagggtttattggtgtaaattgtttgggtaggtttgttgttttaggagtttttttaggttagtgtggaaggaaattaagataatggggagaagtagtttggttgggtttaattttatttttatatgtttgtgtttagttaattatttgggttgtagtttgataggagttggagttggtgttttatttttagagggggtttttgattgtttttgtagagtgagggaggtttgggggtgtagaggttaagggtttttgtagagtttgttttaggttttttgagtttaagtttttttgtagttaatggaagatttttttgagagtgggtgttttttattttgtttgtttagtaggtgtttagtaattgtttattggataaataatgaatttgtggatttaatgtgaagatgatttaaattagtgtttttttatagaattttttgtaatgatgttaatgttttgtatttgttgtagttaatatggtagttatatgtggtagtgaatgtttgtaatgtggaagggttattaaggtaaagagttttgtatttatgttataatttaaatttaaatagttataaatgtttagtgtgtgttttgttatatagattttttttgttattttttttttttttttagagatattgtatttgttattaattttttatttgggaggtaaatggagaaatgttattttttagttaatgtaaaagaaggttaatatttgtattttaagttagttttttgggtaatttttttaagtattttttattaaggttagtttagtaatattttttgattgtttgttatgtattaggaaagtattttgttgtggttttggtttgaggttatggaggatatagaaataattaaggttaagttgatagaaggggtgtgataagatggtttaaagttattgagttagttaggaggtttaggagtatggaagttttgttttttagaggataagtggtaatttatttagggggggtttgagtatttagagttaggagtgtagaagtagggggttttaggttggaaagtggtattagggttaggttgggtggtagtatgaatttatttttgaggttttgggggtggaaattaagggttttatgagtaagaagatttggtttaggtttaatggaaatgattgggtggagggattttattatttggtttttagtatatagggagggaagtggtaattgttttttaaatgttggttgtggaggggaaggagttatagtagggtaggggtggggaggatggtatttgttggtttaaggagggatgatggaggtttaattaagatatgattgtgattggggtagtttgtttaagggttagtatgtagagggtgagttgatgagattttggtagtttgttgagatttgggggtgttggggaggtagaggttaaggttaattttgagattttttgtttgtaaatttgggtgggtggtaaggttgatattagagaaatagaggaagagtgggtagttatgggtgagagaggaagtaatgaattaggggtgtttgtaagagtttaggggtaaggtttttgggtagttaagatgttggtggttttttttatgattagttttttttatgtggtatatttttgtttgtatggttgggtatggggtatttgtttgtttgatatattttgagtagttattttgtgtattgaggtaatgtggtatggtgttttggggaaatagtgaggaggtattgtataggttttatttttttggtattttttgttttttggggatggtggtagttaaataagtgatagttaattgttaggagagtttggttttgatttattaggtggagttaggtatttttgttggaagaggtatgggaattagtataggatgaagggaggtagtgagtattagtttaggttttgtttttatagggttttttttttatatttatttgtgtaggtgttttttgtgagggtagagatatttgtagtgtttgagggagattttttgtgggtggggttgtttatttatagtggttaggtgggaggtgtattagtgttttgtggttgttataatggattatagttgtggggtttgaaaaaatggaagtgggtttttttttatgttggaggttagaggtttaaaattaaggtgttagtaaggttatattttttagggaggttttggggtggggtggggggggggtttttttttgtttttttttagatgttttttggtttggggttgtgttattttattatttgtttttgtttttatgtggttttttttggtgtgtttgtggtttttttgttttttttaaggatattagttgttggatttagggtttattttaatttagaatgattttattttaagatttttaattatttatatttgtaaagattttatttttaatttttaggttatattttgaggtttttggtggatatgagtttgtgggggatatggtttaatttaggatagaagggatgatgggggtattggggaaaaggttatatattttagaggtattggaagatggaagagtaggatttagtgatatgggatgttaggtagaggagttggttttaaggattttagttggggtttgagggttagagggagggaagtttaggtattattgagatgaaatgttttgtgtattgtgggaaatagggtaaaagtttgttggatgtttagttagagaggtggttgtttgaggtatagaaaatgagtgaatatgggagagtttattagaaggttatttgggagggtgtggtggtaatatttagaagggttgagaagtgtatttttatagtttagttaaatttatttggggaaatatatgtttttggtagtattagtaatagagaagatttttggtgatgttattagtgggttatgggatgggtaaattttgtttttttatatagaggaatatttgttagttgttaaaataagtgaattaaggttttgtggatttatatggataagtttttatgttgttatgttgtgggtataggtagggtagttattgattttagtgaggtattaaggatgtgatgttgatgatggtatttaagaggagatagatttaggttgtttagttatatgatgttgatgattgtatgtaagaggagattaggttggatgtggtggtttatatttataattttagtattttgggaggttaaggtaggtggattatttgaggttaggggtatgagattagtttgattaatatggtgaaattttgtgtttattaaaaatataaaaaaaattagttagatatggtggtgggtgtttgtaattttggttattgaggaggttgaggtagaagaattgtttgaatttaggaggtagaggttgtagtgagttgagatggtgttattgtattttagtttgggtgatagagtgagattttattttaaaaaaaaaaaaaaggagatttaggttttttagatatattattgtttagtatagatgtgtttgtttggggttagattttaatttagaggggtgggtattgtagtaggagtggggttaggatggagaaggttatttagggttgtggttatatttgtaatgttttattttttaagtgggatggtgagtatataggtgttttattattttattttttatatttttgttttgtagttttaagaattttattttttttttaaaaggaaagaaagtgtgtgagttgattaaagtgttgattatggtgttatttaagtttttgttagaaatgttatttttggtttagttttaaatataattttgagaagagtttttgtttttttggggagggtaagagttttagatataggagattggttagatgtggatttatagagaagttgggttgggaggatgggatggtagatagttgtttggggagtgttaaatggggaggttggagatgttggggtgtttaggaatgaatttttgtttggattagggttttagtaaaagggaggtagggagaaagaaagaagttaagaagatgaggaaagggtgttttgggttagagtttatagaggtttatagagggaggattttgtgtgttagtaggtagttttatgtaaatttagattattagtttgtagttttgggatttagtaaattatgttttaggtttttaagttgagttgtgattgtggttgttaagtgttgatagtatagaattagttagtttgagtagagggaagtaattgttgggggaggttgtgtttatgtagtttagggtgttaggtttttaagatgtaatttttataagaattgggggattttttttatttattttattagaagttggttaatgagagggaaggagatggagaggtagattagatgtggagttggagaaaagttttttagaaatatagtagtggttgggttgtttagtggttagtgtttaatatgattgtgatgggtggagttttttttaattatagtgttgaattatgtagttgtttaggggtttttagttagagtattatttttttttttttatatatagttttattttgtattgtaaggggttttatatgtatttaatgtggatatggtattttttttatttttattttttgtaaaaagttattttttttattgtttaggtttggtggtgtatagtttatgggtattgtatttatttttggaaggtagatttaggaggtgtttgtgttgtttttatagaagtaagtttaggattagaagtaggttttgggtttagaattttgaggttttaggtgttagtgtggtttggaattgtttagttttatagttattagttatatgtagatataagtggaaatttatttaaaataaataaataattttatgtaagtaaatgagtgaataaagtaaatgtaaatatttatattttgagtgtgtaatagatttaggtggttaagtggttattatataggatggtggagtgtagatgtatagaatagatttattattatagaaggttttattagatggagttggtttagagtatggaggtggtggttttagatgggtatatgtttttgtttttgtaggtgttttgttttggtaggatggttgttttattttgttttgaaggtagttttggtttataggtgttttatttgtgtggatttgattttgggtttgtgttttttggtaattttgttttttttagaatggttaatttatgaaggtatagtttttgtttgtttgttattatgatggtagttaggggtttggtatttagttggtttttagtatatatgtataggtgattatgttatttttgttttttttagagttttttgttttttaggggaggtaagtttatttattgttgtgatttattattttttttaaatagaaaagttattagatgggtatttgttttagtttggttgttggaagtgatagttaagaataatgtaggtttttagaaatagaggtattagtatggttatattggggttaggtaggggagattagggatatttagtggggagaagatgatgtgtagatttagttttggggggtaagggttggaggtagagttttgatttttttgttttatttttttgtttaggttgtatttagtgttggtagagtttttttaagtttataagttgtaatttgtgttttggatggttagttttagagttttgatgggtgtatttgttttttttttttattggttagtgtggaaaatttttaaatatatggaaaaagtataaggagtagtatagtgattattgttagaggtttatttatttttttttagataatattggatgtatttgttttattttggagtattttttattttgtaaggttgtagggagtttatagatattgaattaatattgagaggtttatggttaaagttatttgtttatggtatatttgtttttttagtattttaaattaaattatttagttttatttattttttgtttttttttttgttttgtatatatgggtttgttttttgagtttgggggtggttgtttttgtttttataaggattatttttagtagggtagtgttgataggtttggaagttatttgagtttaaagttgttaaagattgtgtttttttgggaaatgggtaagtggttttatttatttagggaagttaggtggggaggtaggttttagattagaatgaagggattttagtataaatatatttatgagttgggtggggttagagtggagtgagttatttatttgggttattggagttattaagtttttggagttggttattggaggtttgtgtgttttttaaagatagagataaagggtaaaggttatataaggttattggtgttttttttttgggtggatgattaatattaggaatgtttttgtttttgtttttgttgtgagttttagagttagaaatggggtttatttggggatagaggttttatttttttaggtaattttggatgttggagggatgatagttattgttgtttggttgttggaggggttttgggttaaatttttatatatatttttttttaagttttattatttttgttttgtagataaggaatttgagtttttatagagtgttatttttttgtggttatatagtgaatgagagttgtatataggtgagtttatgtttattagattttaagttgggttgtatttaagtgtgtttttgttggatggagtttttttttttttttatgtttatttgttttatgaattagggtttttttatattagggtttataatttatgggtagttttgatttagttttttttatttttagggttgggtgtagttgggttggatttggggatggagtgggataggttatttttattttttgttttaggagggaataaaaatagaattttagattaatgtagttttttgtggtatgtgttttttttgtttatatataggttttggtttggggttgtttgttggagaggtttatggtaggtaagttttaatttgaggagatttgttgaggtgttaagttaagtaaatttgaaaggttgttaggaggagtggttttgggagtataggtggttattttattgttgtagagtatggtattttggggatgttttttgggtaatgttatatagttattttttagagagttttagggatatataattagtttagttttattaatagtgagataagggattaggtagatttagatatttttttgtatttgattattatgttggttgttggttaaagatgttagtttttttttggaattttttagaaaggtttttgtagtatttatttatttatttatttatttatttattttatttatttatttatttatttatttatttatggattttatttattttattatttttttatatatttatttatttatttatttaatttatttatttagttttttatttatttatttatttattaatttatttatttgtttatttaatttatttatttattaatttatttatttattatttatttatttatttatttatttatttatttttttatttatttatttatttttttttttatttattttataattttatttttaaattgtgattagatggaaatgggtgtagttagtttgtttttaaaggtttagagtggaggtagagtgaattgtttatttggtttttgtgtttagtagtttaggtttgtatatatgttttataattataggatattagatttagtaattggtagtagaatgagtatagtgtattttttgtggaattagtattgatagggtatttatttttattaagtttgagtttttttggtgttggagggaatttttagatgggttttaattttagttgaatttattttttagggaaagtaatattgtgagaaatgtgtgtgatataaggttttaaagagggtgtgggttgtgatttttggagtaattagggaggttttatggaggagatgaggataaagttgagttttgaaggagggattggaggatgttgagtagggatatttatttttgtttgtgagggtttgatggtaggttgtgagttgtattttagttttgatttatttaatttataattttagtaggtaggtgtttttgttttattttatagaggaggaagtgaggtttagggttgggtaaattgtttaaggttgtatagttgtggaatttatttttagtatttttagtttgttttagttatgtttgtgattttatttagtattttttttttggtgtttatttattttgtttattgttaagtaataaaaattttattaggaaaatttaggggtttttggttagtttttttagatagaaaggtagattttggtgtagatttttaggaagtaaggatggaagggttagtatttgttttttagaaatgatagtttttttaagattaggagagatggtttagagtgtagttttggtgggttgtttaggattaggaggggagaggagtggggaggaggatgaattttatttttaaggttgttgagtggtatatagtgagtttggattttttagttttagttgagtttatttttatgatggttatgagtattttttttatatatttgattggaagttgtattgtatataatgtatatggggttattattttttgttttatatatttttatgtatatattattagtgtattattgggatattttgttgtttggggttgagagtgaattagaattttgtttataaatttagtatattttattgtggaaataatggggggtaaggaggggttgtttagtaaagaataggatatatgtttttgaggatggagttatttttggttgagatatttttgtaggggatgttggtgataaaggttgttttatttttttttttgggttagatggatattatttttgttttttgttttttagtattaggtaaaaggaaaatagaagaggttttatttaggttaaatattttagggttttttatttgtaggaaatatgttggtttattttttttaaatttagtatgggggtggagaaatggtggggaaaatagtatttgttttagattttttgggtggagtttttgttttatttatattgtttatttttttgattttttaaaatgggtatttggtgtttggtagtttttggtatagagaagatgtaaagtaaattgtttataagaagggggtgagtgtagtttgagtattttttgtttttgaataaattgttaggtttagtgtagttgttgttgttattgttgtttttaggaagggatttttggttatgagtggttttagtttagttttttggatttaattatttaggtttgtgtttgagtttagtaaagaggtagttagaaaagtttttaagatatttaatgattttgtggttttagttgagaagtgagttatttttatgtgattttaaaataaaatatatttagaaggagagaagataattgaaatttagttgtttggagttattttagatgaaagtatttgagtttttgggaggtaaaggaggtaggaaagtttggagttagatgattagaatttgaatgtagattttgttaggtttttgttgtgggttttgggagatgatttttattttttgagttttagtttttttggggatagagatggtgtttatttataggttgttttgagttaatgaggttatatggtgtaagtattagtatagtgtttggtataaaattaaaatttaataagtgatattattattattattattattattattatttttgagatggagttttgttttgttatttaggttggattgtagtggtatgattttagtttattgtaatttttgttttttaagtagttgagattataggtatttgttattatgttttggttaatttttgtatatttggtagagatagggttttattatgttggttaggttggttttgaattgattttaggtgatttgtttgttttagttttttaaagtgtttggattataggtgttagttattgttatttggttgtgatattattataatattaatattataatagttggttaggtatggtgatttatgtttgtaattttagtaatttgggaggttgatgtgggttagttatttgaggttagtttgagattagtttgattaatatagggaaattttatttttattaaaaatataaaaattagttgggtgtggtggtatttgtttgtaattttagttatttgggaggttaaggtaggagaattgtttgaatttaggagatggaggttgtagtgagttgagattatattattgtattttagtttgggtgatagagtaagattttgttttaaaaaataataataataaataaataaaatatattttgatgagatatggtaaaagatagtagaaggtaggagtttggggatttattatgggttggtgttttaagtagaaagaaatgtagtgtttataagttagagagtagatgttgaagataggagatgagtggggttttttggttttggagaggaaagggtgagtttaggtagaaagagtaaatttagggtgttttgtgtagtgttttttttgtggaattagtttagggtattagtagtatagtttttttttagtagtggagattaggttaattgtttagtgttttttttgtttttttgttttaattttattaagtatagtttttttttgggtatagtagttttgtaggggtggatattgatttatgtatttaggagtttagaggtttttttttttttatttatttatttagagatggagtttttttttgttgtttaggttggagtgtagtggtattaatttggtttattgtaatttttattttttaggtttaagtgatttttttgttttaattttttgtgtagttgggattataagtatgtattattatgtttggttaatttttgtatttttagtagagatggggttttattatgttggttaggttggttttgaatttttgattttgtgatttttttattttggttttttaaagtgttgggattatagatgtgagttattatgtttggttaggggttttttttaatggattttttttaatgtatataatttggggaatttagatataagaaagatatagagtatgaaggttttttattggtttgtttatttttagaggtggggttttaggtggtttaggttggttttaaatttttggttttaagtaatttttttgttttggttttatgttgggattataggtataagttattatgtttagttatttttttttttatttgggttgttatgttagaatttggtaagttataagatggaaatgtttaaataggtatttagaatttgagtagatattatttgatgtattattgttgttattttaatgattgaaatgtatttattatatttgtttttttaaaggttattttagatttttatagattttatttgtgatgtaagatagttattttaaatttttttgtgggtttgaatagattagatttttgaatttttgggtagagtagggatggggttgttttagaggagggtgatattgttatatttttgttttgtttttgtgttgataatgaatgaggtttggatagttttttttttattaaaagttatatttttttaaaaaggagttttttaggatgaggtgttatgataatttaattgtgtataaatatttatttttaataatgatagaagttatttatagaaaagaatttatttttggttgggtatggtggtttaggtttgtaattttagtattttgagaggttaaggtaggtaaattatttgaggtttggagtttgagattagtttgattaatatggtgaaattttgtttttaatgaaaatataaaattagtttgtatgtttgtaattttagttatttaggaagttgaggtagaagaagtatttgagtttgagaggtggaggttgtagtgagttgagattgtgttattgtattttagtttgggtgatagagtgaaatttttttttaaaatatatatatatatatatatatatatatatatatatatatatataaatttatttttatttttttttttgaaatttttgagagaggttaggtgtagtggtttatatttgtaattttagtagtttgggaggttgaggtgggaggatggtttgaggttaggagttggagattagtttgggtaatatagtaagattttatttttattaaaaaataataaaagtttaaaaagtttttgagatagtttttggggaaaggtgggttatggagatttttattttggttatttgtgttttttttgtttgtttttttgtggtttttttttattttgagtttggggtgggggtggtttgagtttaggatgggggtggtttgagtttggggtgggagtggtttgagtttgggatagggtggtttgagttggggtgggggtgttttaagtttgggttgtgggtattttgagtttggggtggggatgttttgagtttggggtgggggtgttttgagtttgggttgagggtggtttgagtttgtgttgggggtggtttgagttgggatgggggtggtttgagttgggatgggggtggtttgagtttggggtgggggtgttttgagtttgggatgggggtattttgagtttgggatgggggtgttttgagttgggatgggggtgttttgagtttgggatgggggtggtttgagttgggatgggggtggtttgagtttggggtgggggtggtttgagtttggggtgggggtgtttaggatgtataggttttattttttttttttgaggtttagtttgtttataggagttgtgaagggttggattaaagttaaaggtttaaattttagatttatttttagatttagtggataattaaaatatttaagtttatttttaaaggaagttgagataaggagataatggttattttttttttttttttttttttgtttttggtttttgttatttggagttgtgttttgaagaggtatattgggtattaggtttttttggttttgtttttattttttgtttagatatagaataatttttttttatttttaaggttgatatgtggggttgtggattaaagttaatttatttatttatgaggggagtaatttttttgttttaggaatttgtttttataggagaataaatattgtagaaggtattgtttttagtggtggtgtatgtttgtaattttagttatttaggaggttgaggtagaagaattgttagaatttaggaggtggaggttgtagtgagttaatattatgttattgtattttaatttgggtgaaaagattaagattttgttttaaaataaaaaaagaatagtattttgtgttaaggttaggggttttagttattttttttgtgaagtggaaggggtattattagtttttgtgagaaggaaatagtttatttaattataaaatgttaattaaaggaggtagtatattggttttggtgtggtgttgttggtttttgtttggggtaggaggagggttgggggagagttaaaagttaaagaaggtttatggaggttgttttttttttggtgattagttttttttttgatggtaagttgttaatagtatttggtttttaggttggggaaggtgagattagtttatatttgtttagggttttgttttgtttgtatgggtagtaggtgtttattttgttagatggttttgtttattatagggtattagtgttagttaaggatttatagagtttttttgtaaaggtttattagtgggtattgggattttgggttttatttatatagggtttttatataaaatataggatgtttagttaaatttggattttagataaataattaataattttttgaagagataaggattttgttgttttatttaagttggagtttagtggtatgattatggtttattgtaattttgaatttttggatttaagtaattttttaattgtagttttttaaagtattgggattgtaggtatgagttattaaggttagtaaataatgaattatttttaggtataagtatattttaagtttgttgtgggatatgtttatattaaaaattaatttttgtttatttgaaatttaaattgaatttattgttgggggagataatggagtgatggattgatagaggagtatagagatagtttttttaaatttttagttgattaaagtttggtttttagtttttttgggtttttagagatgtattaagggtggaagtgattaggagggagataaaaatattgaagtttgagtgttagtattgagttgtgtggttttggataggattgttttttttttgagttttagttttatatgttataattggttaataatagttataaagtatttgaagttaatggttgggagtttgttttaggaggtaggtattattaggatgtagagagagtgaggagtttttaaagttagtttaggttaggtatagtagtttatgtttgtaattttagtattttgagaggttgaggtgagagaattatttgagtttagaagtttaaggttgtagtgagttgtaattgtattgttgtattttaggttgaatgatagagtttttgtttttaaaataaaataaaataaaataaaataaaataataaagttagtttgtgtattggattgtatgttgttttaaagtatttaaagtgagagaggttaggaagtaatgagatgtagaaaggtagggggaggaggtttagaggtattagagaagatagttgatttttatttttatatatttttggggtattttgagttttatttatatatttaggtgagaatttttgtatttgtgaaagtaatttgaggttgagagaattaataggaaattgttttattttttatgtagggtttttttataaataaggttgagttgtagtttattattgtagttgagttttttgtagtagttgtggtggggaaggttttttaggaggtttgagtaatttagaaatatttatagtatattttttagtttttttagaggtttttgttgagatgaaagtgttttggtttgtggttaaagagtttagtatattgggtagttatagtttttattatattgatttggttattaggtttttatgaatttagtgaggggagatgggttttttagggaagtttgttgatttttttatattgttgtaaatgtaaagtttggtgattttattatttttagtaattgtgatgtagtaataataagaatagttatgtttattgtttattgaaggtatatgatgagttagatattgtgttggtatatgtgatttttggaggtaatatatttttttttaaggaggaaatgattgagttttggagggagggttttttatttggttttaggtttttttttgatttgtgtttttttttttttttttgtttgttttattgtagtttttttggtttttttgttgtttttggaatgtattaagtttgtttttagtttagtttttgtattgttggtttttttttgtttttttaattttaatttagttgttattatttttgtgattttttattatttattttaaagtagttattagttattttttatgtaattattttattttaatttttattatagtttttagttttattttgatagtttttagaattgatgaatttattgattttgtttttttttattgtatgtaaattttaagaaataagagtttttgtttgtttattgttgtgttttagtgtttgttatagtatttggtatgtagtaggtgtttaatgaatatatttttaaaagaatgaatgattggaaggagtttgaaagaatgatggtttgtgttaatagtttatttttaatttttttagatgggatggagattattattatgtaattatgatttttttgagtttgtgtggtggttgatggtaggtgttagtttggttggattaagggatggttggtaatgtattgtttttgggtgtgtttgtgagggtgtttttggaggagatgggtatgtgagttggtgggttgagtggtaaagatttttttttaatatggatgatattattttattgttagataataaaaaggtagagaaaaggtgaatttttttttttttttggaggtgggatgttttttttttttgtttttggatttagaatttttagttttttagtagttttttaggtttttaaatttttggttttaaattaagagttatattaatagttttttagttttgaggtttgtagatttggattgagttatgatattggtttttttgggtttttagtttgtggatggttttttgtggtatattttggtttttataatggtatgagttaatttttttaataaatttttttttatttatttattatttatttttttaattgtttatttgtttatttatttatttatttattatttattttttatttatttatttattatttatttaattaatgtatttatgtttgtttgtttattggttatttatatttatttattaattatttatttatttattatttatttgttatttatttagttatttatttatttatttatttattttttttttttttttgagatggagttttattttgttgtttaggttggagtgtagtggtgtgattttagtttattgtaatttttattttttaggtttaagtgatttttgtgttttagttttttgagtggttgggattatagatatgtattattatgtttagttaatttttttatttttagtagagatggggttttattttgttagttaggttggttttaaatttttggttttaagtgatttattggttttagtttattaatgtgttggttattataggtaagagttattgaatttaatttattatttgtttgtttgtttgtttgtttgtttgtgtttatttgtttgtttggttatttattatttatttatttatttgtttgtttgtttgtttgtttgtttgtgtttgtttgtttttatttttttgtttgtttgtttatttagttatttgtttgtttgtttgtttgtgtttgtttgtttttttttttttttgtttgtttgtttgtttatttagttatttatttatttatttattttttattggttgtttttttggagagttttggttgatgtagatggtgttttggtaagtttaggttgttatttagattattgtggagggagtgatttaaataatagatatgtattttttagtttgagaggtttaaagttttggattaaggtgttgttagggttagtttttggtgaggtttttttttttggtttgtatttatttttttgttgtgttttttgttattttttttttgtttataagtgaggggggaggagagatttttggtgtttttttttttttttataaggatattaattttattagattagggttttgttttatgattttatttaattttaattatttttttaaaagttttatttttaattatagttgtattgggagttagggttttaatgtaggaatttaaggggaagggtatagtttggtttataataaatgggaaattatgtttatgattaaattttttagaagatatggtttattagtgttgttaatgattgtaagtaaaggttagagaggaaaggggtttttgtggggtggggggtggtgggggtagttggtgttgggaataaggtttttttttttgtttaatagtagggaagtgaggttggttgtagatgttatttggggtgggaagagaggggagtttttgtttgtatattttgtgtgggttttggtttgatttttttttgtgttttttattttttgtgtttttttttgtgtgggagaaatgttgatttttgttggtttaggtgtttaggtttttaggtttgttggttttgggttgggtttaattaatgagaggtttgggaggaatttgggaggtggaagtaagggagggtgtgggagttttttattttttttgttttagatagtttttttagtaggagaggtggttttttgtgtagttttagtttttgttagagttttatttttgtttgggtttttagtaggtgattttggtttttggattttggttataggatttttttttttttatttttatttaggggtggtggtggtattttgttgttaatttttaggttatttttataatgttaagaattttttttttatttgtatggtttttttttaaggtattgagaagggttttaattatatgtttatagggttaaatattttttgtaaaatttataaaatggaaaatattttttttataattaattaatgtttttgtttatttttagttttgagtttttgtttgttatatttttttttgtgtgaggtggaaatggaggtttgttgttatgtgggggtttttgttaaggagaagttgaattggaaagatatttagtttggttttggttgggttatatttatgtagtttttatttatttttatgtatagtttagttattgtttgttattttggtgtggaaatggattttagtaatatttgttttatttattgttttaattttatttattgtgtagaattaaaaattataagatatgaatatattttgtggtgtttggtgttggaaaaatgtgtgtagtggagagaagtaagatttgaaatgtatgggtttagaagtaaatttgtggaaaattatttttattattagaggtgaagttgtaagtaaaggatttagtttttttaatgtggagttaaaatagaaaagtttttttggttagaaatatatgtataaatgttttatatgtagttagaaattttttttatttttttattttttttttgatgggaattatatttaaaaaaaaagaaaaaaataggatttattagaatttttgtgtattttgaataaaataattgtagtagtattattaattttatgttgattgttatttttgtatatattttaattattaaaaataaaaataaaatttgattaattaaggagatttatttgttttatttatttatttatttttgagatggagttttattttgttgtttaggttggagtgtaatggtatgattttggtttattgtaatttttgttttttgggtttaagttatttttttgttttagttttttaagtagttgggattataggtgtgtgttattatatttggttaattttttatgtttttggtagagatggggttttattatgttgattaggttggttttaaatttttgattttaagtgatttgtttattttaattttttatagtgttggaattataggtgtgagttattatgtttagtttatgtttttttttgttgttttttttttttttttgagatatggttttatttttttatttaggttggagtgtagtggtatgattatggtttattgtagttttgattttttgggtttaagtaatttttttattttagttttttaagtaattgggattataggtgtatgttattatgttttgttagtttttgtatttttagtagagatggggttttgttatgttgtttggattggttttgaatttttggttttaagtgatttatttgttttggttttttaaagtgttgggattataggtatgagttattgtgtttagtttgattagttttttgtttttgaaatagaaaatgatattataaagttattatattgaagaagtaatgttaaaaatgtgggagaaatagaattttggagatatgattgatagttgattggtatttttttgtatgtagtgatgtttgtgatatttaatagttgtttataatttataatttgttgttatttatttttttattttaaatgaattattgtatttatatttttagagggttgtataagtttatattattttgattttttgttgattgtttttttgttttttgtttggtttttattttttttattatttgtgtaattagttttttgtttttaagtttttttgttttaaatgtttaagtggattaggtattgtggtttttgtttgtaattttagtattttgggaggtttaggtaggaggattatataaatttaggagtataagattaatttgggtaatatagtaagattttgtttttatatatatataaaaaatataaaaattagtaaggtgtgatggtatatgtttgtagttttagtattttgggaggttgaggtaggaggattgtttgaggttgggagtttaggattagtttgggtaataaagtaagattttgtttttataaaaataaaagaaaaaattaggtaggtatatagtgtgtatttatagtttgagttatttgggaggttgagaagggaggattgtttgagtttaggagtttaaggttgttatgagttgtgattatattattgtattttagtttgtgtgatagagtgagattttgttttgggaaaaataaataaataaataaataaataaataaataaataaatgtttaagtggtttttattttttggttagattttattatatattttatgaataaattgtatgtatgagaaaggtgagtagatgaatagggtagggttagggggttaaggggaagattatagattatgtggagtgagattagtggttaaaaattgttaattatagttaggtttggtggtttatgaaggtaattttaatggttgggtttggtggtttatgtttgtaattttagtattttgggaggttgatgtgagtttattatttgaggttaagagtttgagattagtttggttaatgtagggaaattttgtttttattaaaaatattaaaattggttaggtatggtggtgggtgtttgtagttttagttatttgggaggttgaagtaggagaattggttgaatttgggaggtggaggttgtagtgagttgggattttattattgtattttagtttgggtgatagagtgagattttattttaaaaaatttaaaaaaaaaaaaataaaaaattgtagattttaataaggaagagttataggatgatattttaggatgtgggaaaaggttatgttagttttggattttttttgattaatgggtattttagttattaaaggggtagatgtgttttatttaatttttatttagttattagagtataatatagggatgtgttatagatagagatggagattaataggtagaggggtgatggggaggaagattgaggtaagaggaataaaatggggattgtagagggtaggtggtaggagtttgagggttttagaagaaattgttgtataagtaatgagttagtagggtgagtgatggttaggagaggtggtttaagaaaataaagagatatttttgggggtatagatgtgttttgaggggttgaggaagagatggggaaggggtggttttgtggatttttggtatgattgttgtggtgaaaaggaattaaagattttgataaggggatgattttttaaataaggaagttttgggtttttgtagggggattagtagattgagggtaaatggtattttgtttattaaagttttaataaaatgttaaggtaagaatatttgtttggttttgggggtaattttagaaatattagaaaagggatttattatgtgtaatttttttttaattatttggagaaatgtatggttatttaagatagagaaaggtagttaaagtaagtggaggttaggtatagtgatttatgtttgtatttttagtgttttgggaggttgaggtaggaggattgtttgaggttggaaatttagtattagtttaggtaataataaaataagattttgttgttataaaaataaaaataaaaattttttgagatggagttttattttttttgtttaggttggagtgttgtggtatgattttagtttattgtaatttttgttttttagatttaagtaatttttttgttttagttttttgagtagttgggattataggtatgtgttattatgtttagttaattttgtagttttagtagagatagggtttttttatgttggttaggttggttttgaatttttgatttttttggttttttaaagtgttaggattataggtatgagttattgtgtttggttgttataaaaattttttaaaaattagttaggtatgttaggtgtggtggtttttatttgtaattttagtattttgggaggttaaggtaggtggattatgaggttaggagtttgagattagtttgattaatatggtgaaattttgtttttattaaaaatataaaaattagttaggtgtggtggtatatgtttgtaattgtagttatttaggaggttgaggtaggagaattgttttaatttaggagttgggggttgtagtgagttgagattgtattatggtattttagtttgggtaatagagtaagattttgttttaaaaaaaaaaaaaaaaaaaaaattagttaggtatgtagtgtatatttgtagttttagttatttaggaggttgagaagggaggattaattgaaattgggaggttgagattgggaggttatgattatgttattgtattttaatttgggtaatatagtaagattttgtttaataataataataataaataatgtaagtgggtataagaatttatttatttatttatttatttatttatttatgagatagggttttattttgttgtttaggttggagtgtattggtgtaattttggtttattgtaagttttgttttttgggtttatgttatttttttgttttagttttttgagtagttgggattataggtgtttgttattgtatttagttaattttttgtatttttagtagagatggggttttattatggttttgattttttgattttgtgatttgtttgttttggttttttaaagtgttgggattataggtgtgagttattgtttttggttttaagaatttattttattttagtattttggaggttgaggtgagtggattatgaggttagaagattgagattattttggttaatatggtgaaattttgtttttattaaaaaaatataaaaaattagttgggtgtgggggtgggtgtttgtagttttagttatgtgggatgttgaggtaggagaatggtgtgaatttgggaggtggagtttgtagtgagtggagattgtgttattgtattttagtttgggtaatagagtgagattttattttaaaaaaaaaaaaaaaagaatttattttaagatagtaagttttagggttgaagttagtttttatttagttttaggtttaaagttataagtatggttattgtaatatttttatttaggatattattttttaggggtttagatttatattattaaggaggagtgtttatattagtagttggggagagggtggttttttataagatgtaatgtttattttgaagagttattatagtgataattatgaaatttatgtttgagatttaattttaagtgaaaagaatagaatttaatatttattttatggggagtataaaattttgaaaatatatgttttttataattaaattaaattttatgttatgtttttgaggagataagtattgaatggaatatagaagaaatgttatagttaatgattgttgaagttttttttttaattttttgtttatgttgtttggtaataagtaatatagaaaattgataataaaaagtaaaagagaaagaaaagatatagtgtatagtttagattgttttttttaaaaaattaaataataataataaaaagtataggttgggtgtggtggtttatgtttgtaattttagtattttgggaggttaaggtgggtggattatttgaggttgggagtttgagattagtttgattaatatggggatattttgtttgtattaaaaatataaaattagttgggtatggtgatgtaggtttgtaattttagttatttgggaggttgaggtaagagaattgtttgaatttgggaggtggaggttgtagtgagttgagattgtgtttttgtattttagtttgggtaataagagtgaaattttattttaaaaaaaaaaaaaaaaaagtataaatgtaagttgggtgtggtagtttatgtttgtaattttagtattttgggaggttggggtaggtggattatttgaggttaggagtttgaaattaatttggttaatatggtgaaattttatttttattaaaaatataaaaattagttaggtatggtggtgtgtgtttgtaattttagttatttaggaggttgaggtaggagaattgtttgaatttaggaggtagaggttgtagtgagttaagattgagttattatattttagtttgggtgatagagtgagattttgttttaaaaattaaattaaattaaattaaataaaataaaaaaaagaagtggtataatataaagttttggtagttaaagtgttaatttttagttattaggaaggttttgttatttaatgatttattgttttagttaaggttagttatattttgggtttttgatgttggaggtaatatgatgttaatattggtgagaaatttattatttttttttttttgttttttggtgttggtttttgtgtgtatttgtagtttttttattattggtgtttttatggtgtttatgttattggtttattttttagtaataatttgatagtttgatatttttgtagattttgtggttatagagttaaagttttttgttattagtgggttttgtagataattttttaaatttttttgggttgagttagttaagtttttaataagttggaagatgataggggttggatgtaatttatttttaattggtttgggttatatggatattattttttttttgggatttgatttgggatggaaataggagttatagtttatgggaaggttgtgaaaggaagttttggttttagggtgtggattaggttgatttgtggaataaggttttaggggtggtttatttgtttgttttgtttagttttttttggtaattatatttatttggggtttattttaaatttggtaggtaatgttgttgtttttattttagttgttgttttaatatgttttgtttggttaggataggtgtttaggtatggtatttagggatatttttggtttttggggtttaatttttggtttttaggtgtagtgttgggaaaagtagagggttttggttatggtgtaggttttgttataggttatttaagtagtttgggaggagttggaaagagagtaatgtatttatttggatagagattgaagttatatttttattgagaaaagatgatatttttgtttggattttttttttgaaattttaggttggggtggggtaggagttagtgagagagtttagtgttttaaaggggattttttggttttttgtgttttttaatttagtatttttggggatttatatatttagggtagagtggttatttagggttttttttatttagatataaaggttattgaaggttttgggttaatattgttttgaggatgattagtgatttgagtttttgttagagatagtaggtagtttgggtttaagggttgtttagtgatttgaagttgggattattttatattttttgtgttatttttgttttttgttttggaggtttttaggttgttaatagttatgttttggagaattaggttagattaggttgggaataaagtttagttgttatagagttgttgagaggttattggtaagtagtgtttaggagttgttttttttttgttagtaatagtttaatgtttttttttataggggttgtaaatgggtttatgtttagggtggggttagggagataaagtagagagaaattgggttgggagtagagagtgttatgttttattttggagatttaaggttaggttattttgtagagttggtgtttagagtttttagtgtataggagaggaggtaaatagaatttgatatttagtagtgtttggtagatgtttttggaatgaatgattaaatttatatggagagttgaaatgggttaggaattttagggagatgggtagtttatagtttagtagggttgttttagtagagtaggttaatgttaggttttttggtaaattttttggggtttaggtataattgttatattaggaaaggggtaggggtgattagtttattggttatgggggtattttattgtttttatagaagtttggtatttataggtttgggtgatatatgatttttatgtttggtattatgatggttgtttattaagtttttttatttattaggattgattttttttggttagtgattttagattattatgatttggtagttgttgttaggtttgtttggttaaggatttttttggagattgagttattttatatagtaaagtgagttatggggttatagtgttgtgtgttgtgtataagttttgagggttttatttagggattggtatttattgatttttataaatttttggtaattgtttagagttgggatgtttttaaggtaatagttttaataaatagaggtgtaggaatttagtgtgttattttttgttttattttaaaggtttatatttttaggggtttggagtttttttttggagttttttttattttaaagttagttggatttgtttaggaattgttattattattttttggttgggtttgtattgatgtgtattgaattttttttattaggtttattttaggtaaattttagagtttatgtaatattgtttgtggataaatattggggtggaaataggggttatttttaggttttagttatatggggttgttagggttgtttgggatggtaggagagtgttagaggagggtagtttaaggattaggtagggggtgggaagtgtttttttttatgggtttttaagtgagatgttttttgtaaatatttatttgggatttttaagtagagggttggtttttatgttatttggatttggattttagattattgtttttaagtggtaattttgggtttttttgtatttgttttggtttgagttggttatatttgtggggggtggttttaggaagaaggtggattgttgtaaatgtaatgttttgttgttaggtgtattgtttttggttattagaatttttttgggtaggttggggagatttgatgggtaagtgtttgtggtttggtgtgagtgggtagggtaggtggtttttgtttgggtatgtttttttatttttgtaatagattagggagagggttggttttaggatttaggtttagttagttgttttataattgaggggttttggtggaggatataagttagatagagttatagattaattgtatgaggtggttttttttttttagtttaggttttttgaatgtgttagagtagataagtttggatgtgaggaggtaagaggtagtgagaataggtgtggagatggggttgggggagaagaggaagaaattttgtgtttgtgttttttttatgtttgtttgttattgggttagttgattggggaagtgttttttgagggtgtaattttttgttttttttgtaagttagtttttggggtgttgggtgagggtgtagttttgtttattatggtgagttagtatattgaattatggtagaagttgttttttgtgtgggtgtagtttttttttttgtttaggatttagaagttatgatagtatagagttttttaattgtggttggtgtttttttaggaattttttgaaagttatagagaaattttagagtggttgggtatggtggtttatgtttgtgattttagtattttgggaggttgaggtgggtggattatttgaggtttggagtttgagattagtttggttagtatggtaaaattttatttttattaaaaaatataaaaattagttgggtatggtggtatatgtttgtaattttagttatttaggaggttgaggtatgagaattgtttgaatttgggaggtagaggttgtagtgaattgagattgtgttattgtattttagtttgggtaatagagtaagattttattttaaaaaaataaaaaataaaaaaagaatttttagagtaatttttaggtgttagtaggggtgtgatgtaattttagttttgtttttgtggtttattggttttgggtaagtttttttgttgttgttatttatagagagtttttaggggagtttgggaatgatggtaagttttatgtgatttagtatgtaaagggagttttaaaatttagaatttagagagttagggtgggtatagtgtagttggttttagtgttgaggggttgggggagagattttgtattatgttttgattatagtaagggaagattatggaggtttttggaatgttttagtaatggtgtaattttagttttttttatttttttgttaatgataattatgattatgatagtagttaataggttatagagtaggtattttttagtttttttaaatatgaatttgtttaatttttataataatatagtattgttttatttaataaatgaggtaggttgggtgtggtggtttatgtttgtaattatagtattttgggaggttaaggtaggtagattatgaggttaggagtttgagattagtttgattaatatggtgaaattttatttttagtaaaaatataaaaattagttgggtgtagtggtatgtttttataattttagttatttaggaggttgaggtaggagaattatttgaatttgggaggtggaggttgtagtaagttgagattatgttattgtattttagtttgggagatagagtgagattttgttttaaaaataaataaataaataaaattaaaaaatattatatatataaaaaaataaatgaggtaaatgagatgtatgaggtgagaattttgtgttatagggagaggtgtagtttggtgagatttaattttaaggggttggtggttttgagtttttaagtgtaattattggattatattgtttgtagattattattatttttattttattggaaggttgggtgaggtaattgggaaagtttggagtagtagtggagttgttagagagaatttgtttttagtgtttttttggattttgtagttgttttgtgtgggtttttgttgttttttgtattggaaaagatttttttatagatggggttttatgatgttatttaggttggagtgttgtgtttatttttaggtgttgttatagggttgtagttttgaatttttggttttaagtgatttttttgttttagttttttgagtagttttttgggtttaagtgatttttgtgttttagttttttgagtagttttttgggtttaagtgatttttgtgttttagttttttgagtagttgggattttaagtgtatttggttaagtttttttttattttttattatttaagatttttttttttttaaggtttagtttaattttatttttatttaaaatttttggggtatttttgtagtatttggaggttgaattgtttaggagggaagggtgttaatgagttggtgttttgtttttattttgatttttggtgagaatgtaagttttttgtaggtaaggattatattttattattatttttgtatttatttagatttggttatgtgtgtttagtatataaagtgtttttgatgattgtttatagatttatggtatttgagattgttttaatatatttttttaaaattttttttttttttagaggtttatgaatgtttaaattaggtttattgggaataatattatggttattttgtttattttgaagtttatatataggtttggaagtaataattttgtatagtttagatgaaaaaataaagatttttttgttgtttttggattgttagagttttgggggatttttaatattttttgttgttttttttaattttatggtgttgatggtttgttggggggttagtttgatttttgtgagtgtttgtatttggaaaagggttggtgttaagatagttttaggatatttagaatgagggtaagaggttatttttattattagttttttttagttttattttatataattgtaatatagtgatttagtatattttgggttattgttaagtagggagtaaattagaaatggtttgagttttttttttttttatttttagaggggtttgtttttttaggtaaatataaggaggtattgaggttgttgtataagagttggtttttgtttattttataaattttatttttatttattgtaaaaggttttgtttttttttttaaaaaaaaaaaaaaaaaagaaatttagtgaggggtggggtaggtgtgtgtggaggagaggagaaaaggataagtgatggtttttttattttttagtaagttgtaggtgtagagattttaagtttgttttagggtttttttggtatttgtgtaggagggtttttgtagaaaaaatttaggatttatgatttgggaggattttggttatttttattgtttggatttattagtgggaggtaaagtgtaagaaattaagggtaaagggttttttttgggtgggttagagattttttggaaagggttatgtattgtgtgatttttataataattttaagtatttggagtatgttggggaggaagttttggtgttaaaattaagtatgtgttatttggaagtttgtttttgtttattagtatattaatttatttatgtttttgatagagttgtgttttgggtgtgtagagggttattttgtttgtaataattgggtgaaagttgaaattttaagttattgatttagaagggtatttttggggaagttttgagtaattttttttgagataaggtattttattatttattttggtttttaaatatggaaagttagaggaaattgataatggtttaaaggtagggggatggttttgatgatttttttatttttaattaaggtttatgattttgtttttttattaataaaaattaatttatggatttttggtaggtatttttttatttgaatgaattaaaggagggatattaaataaatggtttttagatttagaagaggagatgttatttataatttgaggattgaggaggataaaggattttgtttgtttggattttttggagaaaattataaaggaaaaaaaaaaggaaggaaaagataaataatgaagatttggattttttttaatttgtttttgtggttttggtgtgtttatttgtgaaatggaattttagagtgttagagtgggagttttttatgaaatgaaagtttttgaattggtttatggtgaggtttaagttaggttttttttgtttatttaaggtgggttttgttagggtggagtgaggatgttagttgtgggtggtgttttgagtgtaaaatgtgaatttgagttgttaagtttgggtgttgttggatggttttatttggaggttgttttgtgttttattaagtagaggagaaattgaagagaatttgaagaaaggatgttgtggtttggattattagttttagaggttgaatttaaggatatttttttatttagttttgattttatttatttatatagatgtatagggatttaaagtatttggttgatttggaaagttagtgatttttgtgagggtgtaaggggtgaggaagagggagtgttttttagggtagtttttttgatatttgagtaagggttggagatagtgtaggggatggttggtttaggttgaaagtggtttgatagtggttttgttttgggaggaatttgatttgtagtgtgtttgttgtggggatttgtttagttttgggggtgttttgttatttttggttgtaggtatttaggtgagtagtgttggttttgggatattgatttttttttattttgggtgtgaagtttatttgagtaagatttttttatggtgtttttgtggttgttgtttttaggaaagtgtggtggtgaggtagtggggtgtgtgtttttagggtgttaattttgggttggtagtaggaaggtgggaagagggggtggtttgttgtttggagtgtattgattgggttttgttttggttttgtttttgttttgtttttttttggagatgtgtatagaattttggtttagttggttgtggttttgtttttgatttgttttttttttgttttgtgaatgtgtgtgttgagttttatttttgtttatttttgtgttgtgttgtatttggtggagtggggttggtgggtgttgggtttgggagggggtgtttttgtgtggtagtgtagattagattagattaggttaggttgggggtgggggttgtttgtgtggtttgttgtgtttgtagttttgtatttttagttttttgtgttggtgttaatggttggttttgggagttgttgtattttttagttttgagtttgggtggggtgggtttggttaggtggaagtgggtggaggtgtgggtgttttgggtggttttgttgggtgaggtggtggtgttgggtattgtggtggtgttgggtatagttgggggttggagttggggtgttggtttagtgggttggggtagggtgggataggatatttgttttgttatttttttggtaattaaaagggtagagtgtgttgattgagttggagttttagtttttttatttgtaaatgggtgtgttggatagatgattatttgttttttttgtgttgggtattgtgtgtagtttggtgtattggtgtagtggggtagatatagggagttgttttttataatttgggtaatg

SEQ ID NO: 12 - DNA, 1405 bp, Artificial Sequence
  source 1..1405: /mol_type="DNA" /note="chemically treated genomic DNA (Homo sapiens)" /organism="Artificial Sequence"
tgttatttgagttgtaaagggtggttttttgtgtttgttttgttgtattgatatattgagttgtgtatggtgtttagtgtagggagaataaatgattatttgtttaatgtgtttatttataggtgaggaaattaaggttttaatttaattgatgtattttgtttttttgattattagaaaagtagtaggataggtgttttgttttgttttattttggtttattaagttggtattttggttttgatttttggttgtgtttggtgttgttgtggtgtttggtgttgttgttttgtttggtggggttgtttggagtgtttgtatttttgtttgtttttatttggttgggtttgttttgtttggatttgggattgggaagtgtggtgatttttggaattagttattggtgttagtgtggggagttgggggtgtagagttgtgggtgtggtgggttatgtaggtggtttttatttttggtttggtttggtttggtttggtttgtgttgttgtgtgggggtgtttttttttaggtttggtgtttgttagttttgttttgttaggtgtagtgtagtgtaggggtgggtgggggtggggtttggtgtgtatgtttatggggtggggagggggtgggttaggggtgggattatagttggttgggttggggttttatgtgtatttttggggaggggtggggtgggggtggggttggggtggggtttggttggtgtattttagatggtgggttgttttttttttttgtttttttattattggtttaggattagtgttttgggagtgtgtgttttgttgttttgttgttatatttttttgggagtggtggttatggaggtattatgaagaagttttatttaggtgggttttgtgtttggggtggggaggggttggtgttttgggattagtgttgtttatttgagtgtttgtggttgggagtggtgaggtgtttttggagttgagtgagtttttgtggtgggtatattgtaggttgagttttttttaggatagggttgttgttgggttgtttttgatttgagttgattgttttttgtgttgtttttagtttttgtttgagtgttggaggggttgttttgggggatgtttttttttttttgttttttgtatttttgtaggaattgttgattttttaggttggttgggtgttttgggtttttgtgtgtttgtgtgggtgaatggggttggggttaggtggaggggtgtttttgggtttagtttttagggttggtggtttaggttgtagtattttttttttggattttttttggttttttttttatttagtggggtatgggatggtttttagatgggattgtttagtagtgtttaaatttggtgatttgggtttatgttttgtgtttaggatgttgtttgt

SEQ ID NO: 13 - DNA, 1405 bp, Artificial Sequence
  source 1..1405: /mol_type="DNA" /note="chemically treated genomic DNA (Homo sapiens)" /organism="Artificial Sequence"
gtgggtggtgttttgagtgtaaaatgtgaatttgagttgttaagtttgggtgttgttggatggttttatttggaggttgttttgtgttttattaagtagaggagaaattgaagagaatttgaagaaaggatgttgtggtttggattattagttttagaggttgaatttaaggatatttttttatttagttttgattttatttatttatatagatgtatagggatttaaagtatttggttgatttggaaagttagtgatttttgtgagggtgtaaggggtgaggaagagggagtgttttttagggtagtttttttgatatttgagtaagggttggagatagtgtaggggatggttggtttaggttgaaagtggtttgatagtggttttgttttgggaggaatttgatttgtagtgtgtttgttgtggggatttgtttagttttgggggtgttttgttatttttggttgtaggtatttaggtgagtagtgttggttttgggatattgatttttttttattttgggtgtgaagtttatttgagtaagatttttttatggtgtttttgtggttgttgtttttaggaaagtgtggtggtgaggtagtggggtgtgtgtttttagggtgttaattttgggttggtagtaggaaggtgggaagagggggtggtttgttgtttggagtgtattgattgggttttgttttggttttgtttttgttttgtttttttttggagatgtgtatagaattttggtttagttggttgtggttttgtttttgatttgttttttttttgttttgtgaatgtgtgtgttgagttttatttttgtttatttttgtgttgtgttgtatttggtggagtggggttggtgggtgttgggtttgggagggggtgtttttgtgtggtagtgtagattagattagattaggttaggttgggggtgggggttgtttgtgtggtttgttgtgtttgtagttttgtatttttagttttttgtgttggtgttaatggttggttttgggagttgttgtattttttagttttgagtttgggtggggtgggtttggttaggtggaagtgggtggaggtgtgggtgttttgggtggttttgttgggtgaggtggtggtgttgggtattgtggtggtgttgggtatagttgggggttggagttggggtgttggtttagtgggttggggtagggtgggataggatatttgttttgttatttttttggtaattaaaagggtagagtgtgttgattgagttggagttttagtttttttatttgtaaatgggtgtgttggatagatgattatttgttttttttgtgttgggtattgtgtgtagtttggtgtattggtgtagtggggtagatatagggagttgttttttataatttgggtaatg

SEQ ID NO: 14 - DNA, 2365 bp, Artificial Sequence
  source 1..2365: /mol_type="DNA" /note="chemically treated genomic DNA (Homo sapiens)" /organism="Artificial Sequence"
gtggttgtggtgggggtgttagttgtaggggtgtttttggtgggtgggagttggtggttttttgttggtgttatgggatttgtatgtttgttttgtgttttttggtttttgagtttataggttgggattttgtttgttagttgtgtgtgttgttgtttaatttttgtaggtgtagagtgtgtggtggtggtgatagagaattttgtttggttgtttaaatatagttttttgtagaaggattttgtgtttggggaaggggaggaatttttttttttttgggtgtttgttttttttgttatggtttggtttttatatttgtttatatttggttgtagtggggtgtttggggggaggggttgaggttgtgttttttgttgttttttgggtgtgggttaggtggggaggaggggggtgttttggttgtgtgtttaggattgttttttagtggttatttgggttttagttttttaggtttggttttgataggtgggtggagtagttagtgtgagatagggaggttggtgtgggtgtgggaatttgatttgtttgggaggtgggggtggggtgggggtgtagtgtgtggggaggggttggtgtttgttttttttttttatttatttagttgagttagggggtttaggggtttttttggtggttagttttgtattgtaggagtgtgggtgtggtgttttagttagtgtgtagggtttgggttttgttgggggtgtttttttgttgttgttttttgtgtgatttgttgtttattagttattatgttggattttgtggttaatgtgtagttggatgggattattttggattttgaaggtgggtgttgggttggttgttgtggttgtggatgtgttggagaggattttgtgggtgggtttggtgtgggatgggggtgtgttgaggggagatgggagtgtgttgaggggagatgggatttttaatttaggtgtttttttgttgagagtgttgtgtgtttttggttttgtgtttgtgttgtttatgtgggggattttgttaggggtatttgtgtagattttgtgtgtttttataggattttgtgtttgttttgtgtattgttgtttgggtttttttttttttattgttgtttgtgtttgttaagtgatagtgatttttttgagggtttgtgaggttgttttggaattttttaggatgtatagttttattttgggaaatttattggttttttttttttggttttttttggtggtttttgggttttgtttggatttggtaatgggatagggaggttgttttttatttttgattgagtggatagttgtgttttgtttgggtggatagttttttttttttttatgttagttttggggttgttaagttgtgtagtttgtgggttgggagtattgaatggatatagtttaggttgtggtagggtttagagtgggatgttttatggtttttatttaggtttggggatatttttatttgttttttagaattgggttgtgggggatagaaggggtttgtgtgtgggtagggagagtattttggtttttttttgtttttggggtttataaagtgtgttgggatttgtggggttgttttgtttaagtttgggtttggtgtttgtgtttttgagtttgtgagtgtgtgtgtttttttgtgtttttttgattgttggtgttggggttttgtgttttgtgtttgtgggagtaaatatagtaggtgaaggggaagtttatataatggtttttagtgttttggggtagggtttttgaggggtgggtttgtttttgttgggatttggagtttttgttttttggagaggtttttaggttgatttgggtagagttttttggtgggttgggagggggaaaggttgtgttgaaatgagtaaattgtttaggtgttaggttaagttgggaggtgattagtttgaggttttttttgttttatggttagaattagggttgatatttgggtgttttgagtttagttgtttatatggtttatttggggttagttttatttgagtgggggaggtggggttttttgggggattagaattttggttggatgttaagtagagtgttagtggttgttttttagggttgggtttgaggagggtgtggggtggtgaagggatgggagggggttgtgatttagtggttattggtgttgtgtagagtgtgagttggaaatattgtagttattttgttagtttagtggtgaaagtttttttttaggttttatttttttgtatttttgttttttagagggaggggaggtttgggtttgtagagttgggagggtttgttgtttttgttttttttttttataatatttttttatttggatatttttgggtatatgt

SEQ ID NO: 15 - DNA, 2365 bp, Artificial Sequence
  source 1..2365: /mol_type="DNA" /note="chemically treated genomic DNA (Homo sapiens)" /organism="Artificial Sequence"
gtatgtgtttaaagatgtttagatgaggaggtgttgtgggggaggggggtgggaatagtaagtttttttagttttgtagatttagattttttttttttttgggaagtagggatgtaaagggatagagtttgaaaaagggtttttattattaagttgataaagtaattatgatgtttttagtttatattttgtatagtgttagtggttattggattataatttttttttgtttttttgttgttttatattttttttaggtttagttttgaagaatagttattggtattttgtttggtgtttagttaaagttttggttttttaggaggttttgttttttttatttagatagggttgattttaggtgggttgtgtgggtagttgggtttaggatatttagatgttagttttggttttggttatggagtggggaggattttaggttggttattttttagtttggtttgatatttggatagtttgtttattttaatatagttttttttttttttggtttattagagggttttgtttaagttagtttaggagtttttttgaggggtgggggttttaggttttggtagaggtaggtttgttttttagaagttttgttttagagtgttggagattattgtgtgagttttttttttgtttgttgtatttatttttgtggatgtaggatgtagagttttagtattggtagttaagaggatgtaggaaagtgtatgtatttataggtttagagatgtggatgttagatttaggtttggatagagtagttttgtaagttttaatatattttgtaaattttgaagataggagagagttaaaatattttttttgtttgtatgtaggttttttttgttttttatggtttgattttgggaggtggatgaggatatttttaggtttggatgggggttatgggatattttattttagattttgttatgatttgggttgtgtttgtttggtgtttttggtttatgggttgtataatttggtggttttgaaattggtgtgggggaggggagggttgtttatttgagtaggatgtggttgtttatttagttggaggtgaggaatgatttttttattttgttgttgggtttaagtggggtttgagagttgttggggagagttaaagggaggggattgatggattttttagagtgaaattgtgtgttttggagagttttgaggtagttttgtgagtttttgaggaggttgttgttgtttggtaaatataaataataataaaaggaaggaaatttaggtggtagtgtgtagaatgagtatagggttttgtgagggtgtgtagggtttatgtgggtgtttttaatagggttttttatgtaggtggtgtgggtatggggttgggggtgtgtggtgtttttagtgggagggtgtttggattaggggttttgtttttttttagtgtatttttgtttttttttagtgtatttttgttttgtgttaggtttatttgtagggttttttttagtatgtttgtggttgtagtagttagtttagtatttatttttgaagtttgaaatgattttatttagttgtgtgttgattgtggggtttgatatgatggttggtgggtagtgggttgtgtggagggtagtggtgaggaagtgtttttggtggggtttgggttttgtgtgttggttggggtgttgtgtttgtgtttttgtagtgtagagttagttgttggaggagtttttaggttttttggtttagttgaatgaatgggggaggaaggtgggtgttggtttttttttgtgtgttgtgtttttgttttgtttttgttttttgggtggattaggtttttgtatttgtattggtttttttgttttgtattggttgttttgtttgtttgttaaggttaggtttggggggttggggtttgagtggttgttgggggatagttttgggtatatgattggagtgttttttttttttttgtttggtttgtgtttaggggatggtgagagatgtggttttagtttttttttttgggtgttttgttgtggttagatgtgggtggatgtggaggttgggttatggtgaggagggtgggtgtttagaggggaagagatttttttttttttttgggtgtagggtttttttgtaggaggttgtatttgggtagttaaataaagttttttgttattgttgttgtgtgttttgtgtttgtaagggttaaatggtagtgtatgtggttggtaggtaggattttggtttgtgggtttaagagttgaggggtgtagggtgaatatgtgagttttatggtattagtgagaggttattaatttttatttattgagggtatttttgtagttaatatttttattatgattat

SEQ ID NO: 16 - DNA, 1920 bp, Homo sapiens
  source 1..1920: /mol_type="DNA" /organism="Homo sapiens"
ccaggctgccgtagacacagcctttgctctcccgaaaaacacgttctaggcgccgggattccagatacctgggaaatagagtgcacgcagctgttgagaggcctcgcgcttggcttctcctatcactgaggcgcagaggtgctgtggacagcccagacccacacggcgcccgaggtgaaacagaaccctcagtctccctatgaggccactggcactctcggctgtccccagagctctccgacttagagctgaatgcaaagtaagcgctcgaaatgcagaagtagccggggccgcccacggcacctgcctcgctcggggcgagagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcgggcactctccagggctgtcaggccctccccagccctgcacctgccgcgccgccccacctcgccaggaagtctcagagaccccggggatggggtgggagcgccttcccatcgcgggctcaaaaagaaggaaggacgcccccaggggtcgtagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggcccgcgccctgcaccttgcgccgggcatcccgcgccagtgcctcgctcccagtgccccgcgccccgcgccccgcgccttgccttcaccccgggccagctgcatcgcgcccgcgccgcaggaaccgtggagttggaaagtgggggcgccgcggctggggggctgcttcagctgcgcctcggccagcgatcggcgggccgggctcaaatccagccaggctgggcaggcggtggccgcgcgactggggaccgggcgccccgccctcctcgctcccctcctccttcctctccctccctccagccccttggcctttttcagcccctaccggatctgctcgtccgctgtcctctcttttctctcgctcttcatatcactctccaccccttcgccttgccttcgcctttcttcctccccttgtctcctgccccctcctcttctcccctcccctctaggggcggagcttctcccctccctcccagacaatgctgtggctgcgtccccttccccgccagctcgtccaggctcccgccgccagcgattcttccgggctgggggtggggaggtggggggggagtgcagggttggggaggatgagctggctcccctcacctccttgctgctgccctctccaagagggatggagacttggcccaagctcctcggttcacccggagctgtgacagccactcccagggaacagtcacgctgccctaccaagcccacctccagcggcctggattccccaggcagaggttgtgggattttgttttttctaacatcccagcttattcccaaaagggtttgagccggacaggggctaaacaggccccttcgacttggcgggccggccagacgtgacagcaatgccaaggaggccaagtttctttgtccatttctcacctcccccttttccatccctggacctcctggcgcccccagtacacagaggcccttgagcagcccggctgcaggttccctatctactcagagttctccccctcacgtgcctatccccaaccctgca

SEQ ID NO: 17 - DNA, 1920 bp, Artificial Sequence
  source 1..1920: /mol_type="DNA" /note="chemically treated genomic DNA (Homo sapiens)" /organism="Artificial Sequence"
ttaggttgtcgtagatatagtttttgttttttcgaaaaatacgttttaggcgtcgggattttagatatttgggaaatagagtgtacgtagttgttgagaggtttcgcgtttggttttttttattattgaggcgtagaggtgttgtggatagtttagatttatacggcgttcgaggtgaaatagaatttttagtttttttatgaggttattggtattttcggttgtttttagagtttttcgatttagagttgaatgtaaagtaagcgttcgaaatgtagaagtagtcggggtcgtttacggtatttgtttcgttcggggcgagagaagacgttaggttgaggttttagcgattttaggtattagtttcgaaggagggcggggagatcgtaaaggggaagtgttcggagggttaacggttttcgcgtattttgcgtttttttgaagcgcgtcgttttttcgcgtcggggattgggatttgtttttggggaattcgtttagaagacggcggcggattggggtcgggtattttttagggttgttaggttttttttagttttgtatttgtcgcgtcgttttatttcgttaggaagttttagagatttcggggatggggtgggagcgtttttttatcgcgggtttaaaaagaaggaaggacgtttttaggggtcgtagaaggaggattagttttaagttataatttttttcggatttaaggtaggtcggttggggtttcgcgtttatacggtttttggcgggggttcgcgcgtttcgggagtttcgcggttcggggaggaaagaggagataagagataggcgaggattacggggttgatttagtcggggtagggattatcgtggaaaaattttggcgaggtggggggacgcggaaagagagcggttcgcgttttgtattttgcgtcgggtatttcgcgttagtgtttcgtttttagtgtttcgcgtttcgcgtttcgcgttttgtttttatttcgggttagttgtatcgcgttcgcgtcgtaggaatcgtggagttggaaagtgggggcgtcgcggttggggggttgttttagttgcgtttcggttagcgatcggcgggtcgggtttaaatttagttaggttgggtaggcggtggtcgcgcgattggggatcgggcgtttcgtttttttcgtttttttttttttttttttttttttttttagttttttggttttttttagtttttatcggatttgttcgttcgttgtttttttttttttttcgttttttatattattttttattttttcgttttgttttcgtttttttttttttttttgttttttgttttttttttttttttttttttttttaggggcggagtttttttttttttttttagataatgttgtggttgcgttttttttttcgttagttcgtttaggttttcgtcgttagcgattttttcgggttgggggtggggaggtggggggggagtgtagggttggggaggatgagttggttttttttatttttttgttgttgttttttttaagagggatggagatttggtttaagtttttcggtttattcggagttgtgatagttatttttagggaatagttacgttgttttattaagtttatttttagcggtttggattttttaggtagaggttgtgggattttgttttttttaatattttagtttatttttaaaagggtttgagtcggataggggttaaataggttttttcgatttggcgggtcggttagacgtgatagtaatgttaaggaggttaagtttttttgtttattttttattttttttttttttatttttggattttttggcgtttttagtatatagaggtttttgagtagttcggttgtaggttttttatttatttagagtttttttttttacgtgtttatttttaattttgta

SEQ ID NO: 18 - DNA, 1920 bp, Artificial Sequence
  source 1..1920: /mol_type="DNA" /note="chemically treated genomic DNA (Homo sapiens)" /organism="Artificial Sequence"
tgtagggttggggataggtacgtgagggggagaattttgagtagatagggaatttgtagtcgggttgtttaagggtttttgtgtattgggggcgttaggaggtttagggatggaaaagggggaggtgagaaatggataaagaaatttggtttttttggtattgttgttacgtttggtcggttcgttaagtcgaaggggtttgtttagtttttgttcggtttaaatttttttgggaataagttgggatgttagaaaaaataaaattttataatttttgtttggggaatttaggtcgttggaggtgggtttggtagggtagcgtgattgttttttgggagtggttgttatagtttcgggtgaatcgaggagtttgggttaagtttttattttttttggagagggtagtagtaaggaggtgaggggagttagtttattttttttaattttgtattttttttttatttttttatttttagttcggaagaatcgttggcggcgggagtttggacgagttggcggggaaggggacgtagttatagtattgtttgggagggaggggagaagtttcgtttttagaggggaggggagaagaggagggggtaggagataaggggaggaagaaaggcgaaggtaaggcgaaggggtggagagtgatatgaagagcgagagaaaagagaggatagcggacgagtagattcggtaggggttgaaaaaggttaaggggttggagggagggagaggaaggaggaggggagcgaggagggcggggcgttcggtttttagtcgcgcggttatcgtttgtttagtttggttggatttgagttcggttcgtcgatcgttggtcgaggcgtagttgaagtagttttttagtcgcggcgtttttattttttaattttacggtttttgcggcgcgggcgcgatgtagttggttcggggtgaaggtaaggcgcggggcgcggggcgcggggtattgggagcgaggtattggcgcgggatgttcggcgtaaggtgtagggcgcgggtcgtttttttttcgcgtttttttatttcgttaaagtttttttacgatggtttttatttcggttgggttagtttcgtaattttcgtttgttttttgttttttttttttttttcgagtcgcggggttttcggggcgcgcggattttcgttaggggtcgtgtaggcgcggagttttagtcggtttgttttgggttcgaagaaagttgtggtttggagttagttttttttttacgatttttgggggcgtttttttttttttttgagttcgcgatgggaaggcgtttttattttattttcggggtttttgagattttttggcgaggtggggcggcgcggtaggtgtagggttggggagggtttgatagttttggagagtgttcgattttagttcgtcgtcgttttttaggcggattttttagaggtaggttttagttttcggcgcggggaggcggcgcgttttagaggggcgtagggtgcgcgggggtcgttggtttttcgggtattttttttttgcggttttttcgttttttttcggagttggtgtttgaggtcgttgggattttagtttggcgttttttttcgtttcgagcgaggtaggtgtcgtgggcggtttcggttatttttgtatttcgagcgtttattttgtatttagttttaagtcggagagttttggggatagtcgagagtgttagtggttttatagggagattgagggttttgttttatttcgggcgtcgtgtgggtttgggttgtttatagtatttttgcgttttagtgataggagaagttaagcgcgaggttttttaatagttgcgtgtattttattttttaggtatttggaatttcggcgtttagaacgtgtttttcgggagagtaaaggttgtgtttacggtagtttgg

SEQ ID NO: 19 - DNA, 1920 bp, Artificial Sequence
  source 1..1920: /mol_type="DNA" /note="chemically treated genomic DNA (Homo sapiens)" /organism="Artificial Sequence"
ttaggttgttgtagatatagtttttgtttttttgaaaaatatgttttaggtgttgggattttagatatttgggaaatagagtgtatgtagttgttgagaggttttgtgtttggttttttttattattgaggtgtagaggtgttgtggatagtttagatttatatggtgtttgaggtgaaatagaatttttagtttttttatgaggttattggtatttttggttgtttttagagttttttgatttagagttgaatgtaaagtaagtgtttgaaatgtagaagtagttggggttgtttatggtatttgttttgtttggggtgagagaagatgttaggttgaggttttagtgattttaggtattagttttgaaggagggtggggagattgtaaaggggaagtgtttggagggttaatggtttttgtgtattttgtgtttttttgaagtgtgttgtttttttgtgttggggattgggatttgtttttggggaatttgtttagaagatggtggtggattggggttgggtattttttagggttgttaggttttttttagttttgtatttgttgtgttgttttattttgttaggaagttttagagattttggggatggggtgggagtgtttttttattgtgggtttaaaaagaaggaaggatgtttttaggggttgtagaaggaggattagttttaagttataattttttttggatttaaggtaggttggttggggttttgtgtttatatggtttttggtgggggtttgtgtgttttgggagttttgtggtttggggaggaaagaggagataagagataggtgaggattatggggttgatttagttggggtagggattattgtggaaaaattttggtgaggtggggggatgtggaaagagagtggtttgtgttttgtattttgtgttgggtattttgtgttagtgttttgtttttagtgttttgtgttttgtgttttgtgttttgtttttattttgggttagttgtattgtgtttgtgttgtaggaattgtggagttggaaagtgggggtgttgtggttggggggttgttttagttgtgttttggttagtgattggtgggttgggtttaaatttagttaggttgggtaggtggtggttgtgtgattggggattgggtgttttgttttttttgtttttttttttttttttttttttttttttagttttttggttttttttagtttttattggatttgtttgtttgttgttttttttttttttttgttttttatattattttttatttttttgttttgtttttgtttttttttttttttttgttttttgttttttttttttttttttttttttttaggggtggagtttttttttttttttttagataatgttgtggttgtgtttttttttttgttagtttgtttaggtttttgttgttagtgatttttttgggttgggggtggggaggtggggggggagtgtagggttggggaggatgagttggttttttttatttttttgttgttgttttttttaagagggatggagatttggtttaagttttttggtttatttggagttgtgatagttatttttagggaatagttatgttgttttattaagtttatttttagtggtttggattttttaggtagaggttgtgggattttgttttttttaatattttagtttatttttaaaagggtttgagttggataggggttaaataggtttttttgatttggtgggttggttagatgtgatagtaatgttaaggaggttaagtttttttgtttattttttattttttttttttttatttttggattttttggtgtttttagtatatagaggtttttgagtagtttggttgtaggttttttatttatttagagtttttttttttatgtgtttatttttaattttgta

SEQ ID NO: 20 - DNA, 1920 bp, Artificial Sequence
  source 1..1920: /mol_type="DNA" /note="chemically treated genomic DNA (Homo sapiens)" /organism="Artificial Sequence"
tgtagggttggggataggtatgtgagggggagaattttgagtagatagggaatttgtagttgggttgtttaagggtttttgtgtattgggggtgttaggaggtttagggatggaaaagggggaggtgagaaatggataaagaaatttggtttttttggtattgttgttatgtttggttggtttgttaagttgaaggggtttgtttagtttttgtttggtttaaatttttttgggaataagttgggatgttagaaaaaataaaattttataatttttgtttggggaatttaggttgttggaggtgggtttggtagggtagtgtgattgttttttgggagtggttgttatagttttgggtgaattgaggagtttgggttaagtttttattttttttggagagggtagtagtaaggaggtgaggggagttagtttattttttttaattttgtattttttttttatttttttatttttagtttggaagaattgttggtggtgggagtttggatgagttggtggggaaggggatgtagttatagtattgtttgggagggaggggagaagttttgtttttagaggggaggggagaagaggagggggtaggagataaggggaggaagaaaggtgaaggtaaggtgaaggggtggagagtgatatgaagagtgagagaaaagagaggatagtggatgagtagatttggtaggggttgaaaaaggttaaggggttggagggagggagaggaaggaggaggggagtgaggagggtggggtgtttggtttttagttgtgtggttattgtttgtttagtttggttggatttgagtttggtttgttgattgttggttgaggtgtagttgaagtagttttttagttgtggtgtttttattttttaattttatggtttttgtggtgtgggtgtgatgtagttggtttggggtgaaggtaaggtgtggggtgtggggtgtggggtattgggagtgaggtattggtgtgggatgtttggtgtaaggtgtagggtgtgggttgttttttttttgtgtttttttattttgttaaagtttttttatgatggtttttattttggttgggttagttttgtaatttttgtttgttttttgtttttttttttttttttgagttgtggggtttttggggtgtgtggatttttgttaggggttgtgtaggtgtggagttttagttggtttgttttgggtttgaagaaagttgtggtttggagttagttttttttttatgatttttgggggtgtttttttttttttttgagtttgtgatgggaaggtgtttttattttatttttggggtttttgagattttttggtgaggtggggtggtgtggtaggtgtagggttggggagggtttgatagttttggagagtgtttgattttagtttgttgttgttttttaggtggattttttagaggtaggttttagtttttggtgtggggaggtggtgtgttttagaggggtgtagggtgtgtgggggttgttggttttttgggtattttttttttgtggtttttttgtttttttttggagttggtgtttgaggttgttgggattttagtttggtgtttttttttgttttgagtgaggtaggtgttgtgggtggttttggttatttttgtattttgagtgtttattttgtatttagttttaagttggagagttttggggatagttgagagtgttagtggttttatagggagattgagggttttgttttattttgggtgttgtgtgggtttgggttgtttatagtatttttgtgttttagtgataggagaagttaagtgtgaggttttttaatagttgtgtgtattttattttttaggtatttggaattttggtgtttagaatgtgttttttgggagagtaaaggttgtgtttatggtagtttgg

SEQ ID NO: 21 - DNA, 18 bp, Artificial Sequence
  source 1..18: /mol_type="DNA" /note="PCR primer" /organism="Artificial Sequence"
ctaaaacctcaacctaac

SEQ ID NO: 22 - DNA, 24 bp, Artificial Sequence
  source 1..24: /mol_type="DNA" /note="PCR primer" /organism="Artificial Sequence"
gatttagagttgaatgtaaagtaa

SEQ ID NO: 23 - DNA, 31 bp, Artificial Sequence
  source 1..31: /mol_type="DNA" /note="blocker oligonucleotide" /organism="Artificial Sequence"
cctaacatcttctctcaccccaaacaaaaca

SEQ ID NO: 24 - DNA, 18 bp, Artificial Sequence
  source 1..18: /mol_type="DNA" /note="PCR primer" /organism="Artificial Sequence"
taccgtaaacgaccccga

SEQ ID NO: 25 - DNA, 21 bp, Artificial Sequence
  source 1..21: /mol_type="DNA" /note="PCR primer" /organism="Artificial Sequence"
gttgtttattagttattatgt

SEQ ID NO: 26 - DNA, 19 bp, Artificial Sequence
  source 1..19: /mol_type="DNA" /note="blocker oligonucleotide" /organism="Artificial Sequence"
aaataatcccatccaacta

SEQ ID NO: 27 - DNA, 33 bp, Artificial Sequence
  source 1..33: /mol_type="DNA" /note="blocker oligonucleotide" /organism="Artificial Sequence"
gttattatgttggattttgtggttaatgtgtag

SEQ ID NO: 28 - DNA, 18 bp, Artificial Sequence
  source 1..18: /mol_type="DNA" /note="probe" /organism="Artificial Sequence"
ttaaccgcgaaatccgac

SEQ ID NO: 29 - DNA, 24 bp, Artificial Sequence
  source 1..24: /mol_type="DNA" /note="PCR primer" /organism="Artificial Sequence"
gtgatggaggaggtttagtaagtt

SEQ ID NO: 30 - DNA, 25 bp, Artificial Sequence
  source 1..25: /mol_type="DNA" /note="PCR primer" /organism="Artificial Sequence"
ccaataaaacctactcctcccttaa

SEQ ID NO: 31 - DNA, 30 bp, Artificial Sequence
  source 1..30: /mol_type="DNA" /note="probe" /organism="Artificial Sequence"
accaccacccaacacacaataacaaacaca

SEQ ID NO: 32 - DNA, 59 bp, Homo sapiens
  source 1..59: /mol_type="DNA" /organism="Homo sapiens"
ctgcccaccagccatcatgtcggaccccgcggtcaacgcgcagctggatgggatcattt

SEQ ID NO: 33 - DNA, 59 bp, Artificial Sequence
  source 1..59: /mol_type="DNA" /note="bilsulphite treated" /organism="Artificial Sequence"
ttgtttattagttattatgtcggatttcgcggttaacgcgtagttggatgggattattt

SEQ ID NO: 34 - DNA, 107 bp, Homo sapiens
  source 1..107: /mol_type="DNA" /organism="Homo sapiens"
acttagagctgaatgcaaagtaagcgctcgaaatgcagaagtagccggggccgcccacggcacctgcctcgctcggggcgagagaagacgccaggctgaggtcccag

SEQ ID NO: 35 - DNA, 107 bp, Artificial Sequence
  source 1..107: /mol_type="DNA" /note="bisulphite treated" /organism="Artificial Sequence"
atttagagttgaatgtaaagtaagcgttcgaaatgtagaagtagtcggggtcgtttacggtatttgtttcgttcggggcgagagaagacgttaggttgaggttttag

The invention claimed is:

1. A method for determining methylation of SEPTIN-9 (SEQ ID NO: 1) genomic colon or colorectal tumor cell DNA of a human subject with Stage I or II colorectal cancer following removal of a primary colon or colorectal tumor but prior to further treatment, comprising
  detecting the presence of, or measuring the level of, methylated genomic SEPTIN-9 DNA in a stool, blood, serum or plasma sample obtained from the human subject with Stage I or II colorectal cancer following the removal of the primary colon or colorectal tumor but prior to further treatment, using a primer pair in which one of the primers of the primer pair comprises the nucleic acid sequence of SEQ ID NO: 26, or a complement thereof, and the other primer of the primer pair hybridizes under stringent conditions to at least 9 nucleotides of the nucleic acid sequence of SEQ ID NO:25 or a complement thereof, and wherein the methylated genomic SEPTIN-9 DNA is from colon or colorectal tumor cells, thereby
  determining methylation of the SEPTIN-9 genomic colon or colorectal tumor cell DNA of the human subject after removal of the primary colon or colorectal tumor.

2. The method according to claim 1, wherein the methylation of the SEPTIN-9 genomic colon or colorectal tumor cell DNA is detected or measured at least at one cytosine selected from the group consisting of positions 21, 28, 30, 37 and 39 of SEQ ID NO: 32.

3. The method of claim 1, wherein the human subject has Stage I colorectal cancer when the primary tumor is removed by surgery or resection.

4. The method of claim 1, wherein the human subject has Stage II colorectal cancer when the primary tumor is removed by surgery or resection.

5. The method of claim 1, wherein detecting the presence of or measuring the level of methylated genomic SEPTIN-9 DNA further comprises:
  contacting the genomic DNA from the stool, blood, serum, or plasma sample of the human subject with a reagent selected from the group consisting of bisulfate, hydrogen sulfite, disulfite, and combinations thereof; and
  detecting the presence of or measuring the level of a nucleic acid sequence comprising SEQ ID NO: 33 in the stool, blood, serum, or plasma sample of the human subject.

6. The method of claim 5, wherein detecting the presence of or measuring the level of methylated genomic SEPTIN-9 DNA further comprises using primers consisting of SEQ ID NOs: 25-26, a blocker consisting of SEQ ID NO: 27, and a probe consisting of SEQ ID NO: 28.

7. The method of claim 1, wherein the detection step is performed using quantitative PCR.

8. A method for determining methylation of SEPTIN-9 (SEQ ID NO: 1) genomic colon or colorectal tumor cell DNA of a human subject with Stage I or II colorectal cancer following removal of a primary colon or colorectal tumor but prior to further treatment, comprising
  detecting the presence of or measuring the level of methylated genomic SEPTIN-9 DNA in a stool, blood, serum or plasma sample obtained from the human subject with Stage I or II colorectal cancer following the removal of the primary colon or colorectal tumor but prior to further treatment, in which one of the primers of the primer pair comprises the nucleic acid sequence of SEQ ID NO: 26, or a complement thereof, and the other primer of the primer pair hybridizes under stringent conditions to at least 9 nucleotides of the nucleic acid sequence of SEQ ID NO:25 or a complement thereof, wherein the method further comprises using a blocker that hybridizes under stringent conditions to at least 9 nucleotides of the nucleic acid sequence of SEQ ID NO: 27 or a complement thereof and wherein the methylated genomic SEPTIN-9 DNA is from colon or colorectal tumor cells, thereby determining methylation of the SEPTIN-9 genomic colon or colorectal tumor cell DNA of the human subject after removal of the primary colon or colorectal tumor.

9. The method of claim 8, wherein determining methylation of the SEPTIN-9 genomic colon or colorectal tumor cell DNA further comprises using primers consisting of SEQ ID NOs: 25-26, a blocker consisting of SEQ ID NO: 27, and a probe consisting of SEQ ID NO: 28.

10. The method according to claim 8, wherein the methylation of the SEPTIN-9 genomic colon or colorectal tumor cell DNA is detected or measured at least at one cytosine selected from the group consisting of positions 21, 28, 30, 37 and 39 of SEQ ID NO: 32.

11. The method of claim 8, wherein detecting the presence of or measuring the level of methylated genomic SEPTIN-9 DNA further comprises:
    contacting the genomic DNA from the stool, blood, serum, or plasma sample of the human subject with a reagent selected from the group consisting of bisulfate, hydrogen sulfite, disulfite, and combinations thereof; and
    detecting the presence of or measuring the level of a nucleic acid sequence comprising SEQ ID NO: 33 in the stool, blood, serum, or plasma sample of the human subject.

12. The method of claim 8, wherein the human subject has Stage I colorectal cancer when the primary tumor is removed by surgery or resection.

13. The method of claim 8, wherein the human subject has Stage II colorectal cancer when the primary tumor is removed by surgery or resection.

14. A method for determining methylation of SEPTIN-9 (SEQ ID NO: 1) genomic colon or colorectal tumor cell DNA of a human subject with Stage I or II colorectal cancer following removal of a primary colon or colorectal tumor but prior to further treatment, comprising
    detecting the presence of, or measuring the level of, methylated genomic SEPTIN-9 DNA in a stool, blood, serum or plasma sample obtained from the human subject with Stage I or II colorectal cancer following the removal of the primary colon or colorectal tumor but prior to further treatment, using a primer pair in-which one of the primers of the primer pair comprises the nucleic acid sequence of SEQ ID NO: 26, or a complement thereof, and the other primer of the primer pair hybridizes under stringent conditions to at least 9 nucleotides of the nucleic acid sequence of SEQ ID NO:25 or a complement thereof, wherein the method further comprises using a blocker that hybridizes under stringent conditions to at least 9 nucleotides of the nucleic acid sequence of SEQ ID NO: 27 or a complement thereof, wherein the method further comprises using a probe that hybridizes under stringent conditions to at least 9 nucleotides of the nucleic acid sequence of SEQ ID NO: 28 or a complement thereof and, wherein the methylated genomic SEPTIN-9 is from colon or colorectal tumor cells, thereby determining methylation of the SEPTIN-9 genomic colon or colorectal tumor cell DNA of the human subject after removal of the primary colon or colorectal tumor, whereby the presence of methylated genomic SEPTIN-9 DNA in the stool, blood, serum or plasma sample following the removal of the primary colon or colorectal tumor, but prior to further treatment, indicates that the colorectal cancer of the human subject is aggressive.

15. The method of claim 14, wherein determining methylation of the SEPTIN-9 genomic colon or colorectal tumor cell DNA further comprises using primers consisting of SEQ ID NOs: 25-26, a blocker consisting of SEQ ID NO: 27, and a probe consisting of SEQ ID NO: 28.

16. The method of claim 14, wherein the methylation of the SEPTIN-9 genomic colon or colorectal tumor cell DNA is detected or measured at least at one cytosine selected from the group consisting of positions 21, 28, 30, 37 and 39 of SEQ ID NO: 32.

17. The method of claim 14, wherein detecting the presence of or measuring the level of methylated genomic SEPTIN-9 DNA further comprises:
    contacting the genomic DNA from the stool, blood, serum, or plasma sample of the human subject with a reagent selected from the group consisting of bisulfate, hydrogen sulfite, disulfite, and combinations thereof; and
    detecting the presence of or measuring the level of a nucleic acid sequence comprising SEQ ID NO: 33 in the stool, blood, serum, or plasma sample of the human subject.

18. The method of claim 14, wherein the human subject has Stage I colorectal cancer when the primary tumor is removed by surgery or resection.

19. The method of claim 14, wherein the human subject has Stage II colorectal cancer when the primary tumor is removed by surgery or resection.

\* \* \* \* \*